(12) United States Patent
Xu et al.

(10) Patent No.: US 7,700,834 B2
(45) Date of Patent: *Apr. 20, 2010

(54) NICOTIANA NUCLEIC ACID MOLECULES AND USES THEREOF

(75) Inventors: Dongmei Xu, Lexington, KY (US); Mark T. Nielsen, Nicholasville, KY (US)

(73) Assignee: U.S. Smokless Tobacco Company, Richmond, VA (US)

( * ) Notice: Subject to any disclaimer, the term of this patent is extended or adjusted under 35 U.S.C. 154(b) by 835 days.

This patent is subject to a terminal disclaimer.

(21) Appl. No.: 11/116,881

(22) Filed: Apr. 27, 2005

(65) Prior Publication Data

US 2006/0041949 A1 Feb. 23, 2006

Related U.S. Application Data

(63) Continuation-in-part of application No. PCT/US04/034065, filed on Oct. 15, 2004, and a continuation-in-part of application No. 10/934,944, filed on Sep. 3, 2004, which is a continuation-in-part of application No. 10/686,947, filed on Oct. 16, 2003, now abandoned, application No. 11/116,881, which is a continuation-in-part of application No. PCT/US04/034218, filed on Oct. 15, 2004, and a continuation-in-part of application No. 10/943,507, filed on Sep. 17, 2004, which is a continuation-in-part of application No. 10/686,947, application No. 11/116,881, which is a continuation-in-part of application No. 11/110,062, filed on Apr. 19, 2005, which is a continuation-in-part of application No. 10/934,944, filed on Sep. 3, 2004, and a continuation-in-part of application No. 10/943,507, filed on Sep. 17, 2004, which is a continuation-in-part of application No. 10/686,947, and a continuation-in-part of application No. 10/387,346, filed on Mar. 12, 2003, now abandoned, which is a continuation-in-part of application No. 10/340,861, filed on Jan. 10, 2003, now abandoned, which is a continuation-in-part of application No. 10/293,252, filed on Nov. 13, 2002, now abandoned.

(60) Provisional application No. 60/665,451, filed on Mar. 24, 2005, provisional application No. 60/665,097, filed on Mar. 24, 2005, provisional application No. 60/646,764, filed on Jan. 25, 2005, provisional application No. 60/607,357, filed on Sep. 3, 2004, provisional application No. 60/566,235, filed on Apr. 29, 2004, provisional application No. 60/503,989, filed on Sep. 18, 2003, provisional application No. 60/485,368, filed on Jul. 8, 2003, provisional application No. 60/418,933, filed on Oct. 16, 2002, provisional application No. 60/363,684, filed on Mar. 12, 2002, provisional application No. 60/347,444, filed on Jan. 11, 2002, provisional application No. 60/337,684, filed on Nov. 13, 2001.

(51) Int. Cl.
C12N 15/82 (2006.01)
(52) U.S. Cl. .................................................. 800/285
(58) Field of Classification Search ....................... None
See application file for complete search history.

(56) References Cited

U.S. PATENT DOCUMENTS

| | | | |
|---|---|---|---|
| 4,732,856 A | 3/1988 | Federoff | |
| 4,762,785 A | 8/1988 | Comai | |
| 4,801,540 A * | 1/1989 | Hiatt et al. ................. | 435/411 |
| 4,940,838 A | 7/1990 | Schilperoort et al. | |
| 4,945,050 A | 7/1990 | Sanford et al. | |
| 5,004,863 A | 4/1991 | Umbeck | |
| 5,013,658 A | 5/1991 | Dooner et al. | |
| 5,034,323 A | 7/1991 | Jorgensen et al. | |
| 5,104,310 A | 4/1992 | Saltin | |
| 5,107,065 A | 4/1992 | Shewmaker et al. | |
| 5,141,131 A | 8/1992 | Miller, Jr. et al. | |
| 5,149,645 A | 9/1992 | Hoekema et al. | |
| 5,159,135 A | 10/1992 | Umbeck | |
| 5,177,010 A | 1/1993 | Goldman et al. | |
| 5,231,019 A | 7/1993 | Paszkowski et al. | |
| 5,302,523 A | 4/1994 | Coffee et al. | |
| 5,384,253 A | 1/1995 | Krzyzek et al. | |
| 5,463,174 A | 10/1995 | Moloney et al. | |
| 5,464,763 A | 11/1995 | Schilperoort et al. | |
| 5,464,765 A | 11/1995 | Coffee et al. | |
| 5,469,976 A | 11/1995 | Burchell | |
| 5,472,869 A | 12/1995 | Krzyzek et al. | |

(Continued)

FOREIGN PATENT DOCUMENTS

EP 0 267 159 5/1988

(Continued)

OTHER PUBLICATIONS

Bartoszewski 2002, J. Amer. Soc. Hort. Sci. 127(4):535-539.*
Branch A.D. Tibs, A good antisense molecule is hard to find. Feb. 1998, pp. 45-50.*
Siminszky, et al., 17.6% identical, found in Identity_NUC Database. Accession No. AEK08729 from 2005WO-US005665, filed on Feb. 23, 2005.*
Gavilano, et al. Plant Cell Physiol. (2007) 48(11):1567-74.*
Gavilano et al. JBC (2007) 282 (1): 249.*
Rohr et al. 2004, Tandem inverted repeat system for selection of effective transgenic RNAi strains of Chalmydomonas. Plant J. 40:611-621.*

(Continued)

Primary Examiner—Anne Kubelik
(74) Attorney, Agent, or Firm—Fish & Richardson P.C.

(57) ABSTRACT

The present invention features Nicotiana nucleic acid sequences such as sequences encoding constitutive, or ethylene or senescence induced polypeptides, in particular cytochrome p450 enzymes, in Nicotiana plants and methods for using these nucleic acid sequences and plants to alter desirable traits, for example by using breeding protocols.

12 Claims, 23 Drawing Sheets

U.S. PATENT DOCUMENTS

| | | | |
|---|---|---|---|
| 5,583,021 | A | 12/1996 | Dougherty et al. |
| 5,595,733 | A | 1/1997 | Carswell et al. |
| 5,641,664 | A | 6/1997 | D'Halluin et al. |
| 5,679,558 | A | 10/1997 | Gobel et al. |
| 5,712,135 | A | 1/1998 | D'Halluin et al. |
| 5,766,900 | A | 6/1998 | Shillito et al. |
| 5,929,304 | A | 7/1999 | Radin et al. |
| 6,002,070 | A | 12/1999 | D'Halluin et al. |
| 6,074,877 | A | 6/2000 | D'Halluin et al. |
| 6,907,887 | B2 | 6/2005 | Conkling |
| 2002/0042934 | A1 | 4/2002 | Staub et al. |
| 2004/0103449 | A1 | 5/2004 | Xu |
| 2004/0111759 | A1 | 6/2004 | Xu |
| 2004/0117869 | A1 | 6/2004 | Xu |
| 2004/0162420 | A1 | 8/2004 | Xu |
| 2005/0132444 | A1 | 6/2005 | Xu |
| 2005/0223442 | A1 | 10/2005 | Xu |
| 2005/0244521 | A1 | 11/2005 | Strickland et al. |
| 2006/0037096 | A1 | 2/2006 | Xu |
| 2006/0191548 | A1 | 8/2006 | Strickland et al. |

FOREIGN PATENT DOCUMENTS

| | | |
|---|---|---|
| EP | 0 159 418 | 5/1990 |
| EP | 0 176 112 | 5/1990 |
| EP | 0 120 516 | 10/1991 |
| EP | 0 131 624 | 9/1992 |
| EP | 0 292 435 | 7/1995 |
| EP | 0 116 718 B2 | 5/1996 |
| EP | 0 627 752 | 7/1997 |
| EP | 0 290 799 B9 | 9/2004 |
| EP | 0 320 500 | 11/2004 |
| WO | WO 87/06614 | 11/1987 |
| WO | WO 94/01930 | 1/1994 |
| WO | WO 02/072758 | 9/2002 |
| WO | WO 03/078577 | 9/2003 |
| WO | WO 2004/035745 | 4/2004 |
| WO | WO 2005/038018 | 4/2005 |
| WO | WO 2005/038033 | 4/2005 |
| WO | WO 2006/091194 | 8/2006 |

OTHER PUBLICATIONS

Allen et al., *Nat. Biotech.*, 2004, 22:1559-1566.
Arndt and Rank, *Genome*, 1997, 40:785-797.
Baulcombe, "Fast forward genetics based on virus-induced gene silencing," *Curr. Opin. Plant Biol.*, 1999, 2:109-113.
Bosher et al., *Nat. Cell Biol.*, 2000, 2:E31-36.
Brigneti et al., "Viral pathogenicity determinants are suppressors of transgene silencing in *Nicotiana benthamiana*," *EMBO J.*, 1998, 17(22):6739-6746.
Burns et al., *Genes Dev.*, 1994, 8:1087-1105.
Burton et al., "Changes in Chemical Composition of Burley Tobacco During Senescence and Curing. 2. Acylated Pyridine Alkaloids," *J. Agric. Food Chem.*, 1988, 38(3):579-583.
Chao et al., "A silent mutation induces exon skipping in the phenylalanine hydroxylase gene in phenylketonuria," *Hum. Genet.*, 2001, 108(1):14-19.
Chappell, *Annu. Rev. Plant Physiol. Plant Mol. Biol.*, 1995, 46:521-547.
Chapple, "Molecular-Genetic Analysis of Plant Cytochrome P450-Dependent Monooxygenases," *Annu. Rev. Plant Physiol. Plant Mol. Biol.*, 1998, 49:311-343.
Chelvarajan et al., "Study of Nicotine Demethylation in *Nicotiana otophora*," *J. Agric. Food Chem.*, 1993, 41:858-862.
Cheung et al., *Cell*, 1995, 82:383-393.
Chou et al., *Plant and Animal Genome VII Conference Abstracts*, San Diego, Calif., Jan. 17-21, 1999.
Chuang and Meyerowitz, "Specific and heritable genetic interference by double-stranded RNA in *Arabidopsis thaliana*," *Proc. Natl. Acad. Sci. USA*, 2000, 97(9):4985-4990.
Cogoni and Macino, *Genes Dev.*, 2000, 10:638-643.
Donato et al., "Fluorescence-Based Assays for Screening Nine Cytochrome P450 (P450) Activities in Intact Cells Expressing Individual Human P450 Enzymes," *Drug Metab. Dispos.*, 2004, 32(7):699-706.
Fannin and Bush, "Nicotine demethylation in *nicotiana*," *Med. Sci. Res.*, 1992, 20:807-808.
Fedoroff et al., "Cloning of the *bronze* locus in maize by a simple and generalizable procedure using the transposable controlling element *Activator* (Ac)," *Proc. Natl. Acad. Sci. USA*, 1984, 81:3825-3829.
Fire et al., "Potent and specific genetic interference by double-stranded RNA in *Caenorhabditis elegans*," *Nature*, 1998, 391:806-811.
Forsthoefel et al., *Aust. J. Plant Physiol.*, 1992, 19:353-366.
Frank et al., "Cloning of Wound-Induced Cytochrome P450 Monooxygenases Expressed in Pea," *Plant Physiol.*, 1996, 110:1035-1046.
Freeman et al., *Biotechniques*, 1999, 26:112-122 and 124-125.
Hao and Yeoman, "Evidence in Favour of an Oxidative N-Demethylation of Nicotine to Nornicotine in Tobacco Cell Cultures," *J. Plant Physiol.*, 1998, 152:420-426.
Hao and Yeoman, "Mechanism of Nicotine N-Demethylation in Tobacco Cell Suspension Cultures," *Plytochemistry*, 1995, 477-482.
Hao and Yeoman, "Nicotine N-Demethylase in Cell-Free Preparations from Tobacco Cell Cultures," *Phytochemistry*, 1996, 42(2):325-329.
Helene et al., *Ann. N.Y. Acad. Sci.*, 1992, 660:27-36.
Helene, *Anticancer Drug Des.*, 1991, 6:569-584.
Henikoff and Comai, "Single-Nucleotide Mutations for Plant Functional Genomics," *Annu. Rev. Plant Biol.*, 2003, 54:375-401.
Hildering and Verkerk, *The use of induced mutations in plant breeding*, 1965, Pergamon press, pp. 317-320.
Hoekema et al., "A binary plant vector strategy based on separation of the Vir- and T-region of the Agrobacterium tumefaciens Ti plasmid," *Nature*, 1983, 303:107-118.
Ingelbrecht et al., *Proc. Natl. Acad. Sci. USA*, 1994, 91:10502-10506.
Jorgensen et al., *Plant Mol. Biol.*, 1996, 31:957-973.
Kempin et al., *Nature*, 1997, 389:802-803.
Klink and Wolniak, *J. Plant Growth Regulation*, 2000, 19(4):371-384.
Koornneef, "Classical mutagenesis in higher plants," *Mol. Plant Biol.*, 2002, Gilmartin and Bowler (eds.), Oxford University Press, pp. 1-11.
Koshinsky et al., *Plant J.*, 2000, 23:715-722.
Maher, *Bioassays*, 1992, 14:807-815.
McKinney, *Plant J.*, 1995, 8:613-622.
Mesnard et al., "Evidence for the involvement of tetrahydrofolate in the demethylation of nicotine by *Nicotiana plumbaginifolia* cell-suspension cultures," *Planta*, 2002, 214:911-919.
Mette et al., "Transcriptional silencing and promoter methylation triggered by double-stranded RNA," *EMBO J.*, 2000, 19(19):5194-5201.
Mol et al., *FEBS Lett.*, 1990, 268:427-430.
Napoli et al., "Introduction of a Chimeric Chalcone Synthase Gene into Petunia Results in Reversible Co-Suppression of Homologous Genes *in trans*," *Plant Cell*, 1990, 2:279-289.
Needleman and Wunsch, "A General Method Applicable to the Search for Similarities in the Amino Acid Sequence of Two Proteins," *J. Mol. Biol.*, 1970, 48:443-453.
Nelson et al., "Comparative Genomics of Rice and *Arabidopsis*. Analysis of 727 Cytochrome P450 Genes and Pseudogenes from a Monocot and a Dicot," *Plant Physiol.*, 2004, 135:756-772.
Nelson et al., "Comparison of cytochrome P450 (*CYP*) genes from the mouse and human genomes, including nomenclature recommendations for genes, pseudogenes and alternative-splice variants," *Pharmacogenetics*, 2004, 14:1-18.
Ohshima et al., "Nucleotide sequence of the PR-1 gene of *Nicotiana tabacum*," *FEBS Lett.*, 1987, 225:243-246.

Pearson and Lipman, "Improved tools for biological sequence comparison," *Proc. Natl. Acad. Sci. USA*, 1988, 85:2444-2448.

Puchta et al., "Two different but related mechanisms are used in plants for the repair of genomic double-strand breaks by homologous recombination," *Proc. Natl. Acad. Sci. USA*, 1996, 93:5055-5060.

Qin et al., "Cre recombinase-mediated site-specific recombination between plant chromosomes," *Proc. Natl. Acad. Sci. USA*, 1994, 91:1706-1710.

Reid and Haley, "Studies on the Fermentation of Tobacco 1. The Microflora of Cured and Fermenting Cigar-leaf Tobacco," Bulletin 356, 1938, Pennsylvania Agricultural Experiment Station, State College, PA.

Rodermel et al., *Cell*, 1988, 55:673-681.

Schnable et al., *Curr. Opinions Plant Biol.*, 1998, 1:123-129.

Schopfer and Ebel, *Mol. Gen. Genet.*, 1998, 258:315-322.

Siminszky et al., "Conversion of nicotine to nornicotine in *Nicotiana tabacum* is mediated by CYP82E4, a Cytochrome P450 monooxygenase," *Proc. Natl. Acad. Sci. USA*, 2005, 102(41):14919-14924.

Skarnes et al., *BioTechnology*, 1990, 8:827-831.

Smith and Waterman, "Comparison of Biosequences," *Adv. Appl. Math.*, 1981, 2:482-489.

Smith et al., "Total silencing by intron-spliced hairpin RNAs," *Nature*, 2000, 407:319-320.

Spradling et al., "Gene disruptions using *P* transposable elements: An integral component of the *Drosophila* genome project," *Proc. Natl. Acad. Sci. USA*, 1995, 92:10824-10830.

Stalberg et al., "Deletion analysis of a 2S seed storage protein promoter of Brassica napus in transgenic tobacco," *Plant Mol. Biol.*, 1993, 23:671-683.

Sundaresan et al., *Genes Dev.*, 1995, 9:1797-1810.

Takemoto et al., *Plant Cell Physiol.*, 1999, 40:1232-1242.

Tavernarakis et al., "Heritable and inducible genetic interference by double-stranded RNA encoded by transgenes," *Nat. Genet.*, 2000, 24:180-183.

Thomas et al., "Size constraints for targeting post-transcriptional gene silencing and for RNA-directed methylation in *Nicotiana benthamiana* using a potato virus X vector," *Plant J.*, 2001, 25(4):417-425.

Turner and Schuch, *J. Chem. Technol. Biotechnol.*, 2000, 75:869-882.

van der Krol et al., "Antisense genes in plants: an overview," *Gene*, 1988, 72:45-50.

Verkerk, *Neth. J. Agric. Sci.*, 1971, 19:197-203.

Wang et al., "Suppression of a P450 hydroxylase gene in plant trichome glands enhances natural-product-based aphid resistance," *Nat. Biotechnol.*, 2001, 19:371-374.

Wang et al., "Isolation and characterization of the *CYP71D16* trichome-specific promoter from *Nicotiana tabacum* L.," *J. Exp. Botany*, 2002, 53(376):1891-1897.

Waterhouse et al., "Virus resistance and gene silencing in plants can be induced by simultaneous expression of sense and antisense RNA," *Proc. Natl. Acad. Sci. USA*, 1998, 95:13959-13964.

Weigel and Nilsson, *Nature*, 1995, 377:495-500.

Weising et al., "Foreign Genes in Plants: Transfer, Structure, Expression, and Applications," *Ann. Rev. Genet.*, 1988, 22:421-477.

Werck-Reichhart and Feyereisen, "Cytochromes P450: a success story," *Genome Biology*, 2000, 1(6):reviews3003.1-3003.9.

Werck-Reichhart et al., "Cytochromes P450," *The Arabidopsis Book*, 2002, 28 pages.

Whitbred and Schuler, "Molecular Characterization of *CYP73A9* and *CYP82A1* P450 Genes Involved in Plant Defense in Pea," *Plant Physiol.*, 2000, 124:47-58.

Xu et al., "Biochemical and molecular characterizations of nicotine demethylase in tobacco," *Physiologia Plantarum*, 2006, 0:1-13.

EBI Accession AV557806, dated Jun. 16, 2000, 2 pages.

Allen et al.,"RNAi-mediated replacement of morphine with the nonnarcotic alkaloid reticuline in opium poppy," *Nat. Biotechnol.* 22:1559-1566 (2004).

Byzova et al., "Transforming petals into sepaloid organs in Arabidopsis and oilseed rape: implementation of the hairpin RNA-mediated gene silencing technology in an organ-specific manner," *Planta* 218:379-387 (2004).

Bolitho et al., "Antisense apple ACC-oxidase RNA reduces ethylene production in transgenic tomato fruit," (1997) *Plant Science* 122: 91-99.

Chai et al., "Reducing the maize amylopectin content through RNA interference manipulation," *Zhi Wu Sheng Li Yu Fen Zi Sheng Wu Xue Xue Buo* 31:625-630 (2005), Abstract Only.

Davuluri et al., "Fruit-specific RNAi-mediated suppression of DET1 enhances carotenoid and favonoid content in tomatoes," *Nat. Biotechnol.* 23:890-895 (2005).

Escobar et al., "RNAi-mediated oncogene silencing confers resistance to crown gall tumorigenesis," *Proc. Natl. Acad. Sci.* USA 98: 13437-13442 (2001).

Elkind et al., "Abnormal plant development and down-regulation of phenylpropanoid biosynthesis in transgenic tobacco containing a heterologous phenylalanine ammonia-lyase gene," (1990). *Proc Natl Acad Sci U S A* 87(22): 9057-61.

Faske et al., "Transgenic Tobacco Plants Expressing Pea Chloroplast Nmdh cDNA in Sense and Antisense Orientation," (1997) *Plant Physiol* 115(2): 705-715.

Herbik et al., "Isolation, characterization and cDNA cloning of nicotianamine synthase from barley," (1999) *Eur J Biochem* 265(1): 231-9.

Hibino et al., "Increase of Cinnamaldehyde Groups in Lignin of Transgenic Tobacco Plants Carrying an Antisense Gene for Cinnamyl Alcohol Dehydrogenase," (1995) *Biosci. Biotec. Biochem* 59:929-931.

Kusaba et al., "Low Glutelin content1: A Dominant Mutation That Suppresses the Glutelin Multigene Family via RNA Silencing in Rice," *Plant Cell* 15:1455-1467 (2003).

Helliwell et al., Funct. *Plant Biol.* 29:1217-1225 (2002).

Klahre et al., "High molecular weight RNAs and small interfering RNAs induce systemic posttranscriptional gene silencing in plants," *Proc. Natl. Acad. Sci.* USA 99:11981-11986 (2002).

Levin et al., "Methods of double-stranded RNA-mediated gene inactivation in *Arabidopsis* and their use to define an essential gene in methionine biosynthesis," *Plant Mol. Biol.* 44:759-775 (2000).

Liu et al., "High-Stearic and High-Oleic Cottonseed Oils Produced by Hairpin RNA-Mediated Post-Transcriptional Gene Silencing," *Plant Physiol.* 129:1732-1743 (2002).

Nishihara et al., "Flavanoid components and flower color change in transgenic tobacco plants by suppression of chalcone isomerase gene," *FEBS Lett.* 579:6074-6078 (2005).

Oliver et al., "Inhibition of tobacco NADH-hydroxypyruvate reductase by expression of a heterologous antisense RNA derived from a cucumber cDNA: Implications for the mechanism of action of antisense RNAs," (1993). *Mol Gen Genet* 239(3): 425-34.

Ogita et al., "Application of RNAi to confirm theobromine as the major intermediate for caffeine biosynthesis in coffee plants with potential for construction of decaffeinated varieties," *Plant Mol. Biol.* 54:931-941 (2004).

Salehuzzaman et al., "Isolation and characterization of a cDNA encoding granule-bound starch synthase in cassava (Manihot esculenta Crantz) and its antisense expression in potato," (1993) *Plant Mol Biol* 23(5): 947-62.

Temple et al., "Modulation of glutamine synthetase gene expression in tobacco by the introduction of an alfalfa glutamine synthetase gene in sense and antisense orientation: molecular and biochemical analysis," (1993). *Mol Gen Genet* 236(2-3): 315-25.

Trevanion et al., "NADP-Malate Dehydrogenase in the $C_4$ Plant *Flaveria bidentis*," (1997) *Plant Physiol* 113(4): 1153-1165.

Wang et al., "Elucidation of the functions of genes central to diterpene metabolism in tobacco trichomes using posttranscriptional gene silencing," *Planta* 216:686-691 (2003).

Waterhouse et al., "Virus resistance and gene silencing in plants can be induced by simultaneous expression of sense and antisense RNA," *Proc. Natl. Acad. Sci.* USA 95:13959-13964 (1998).

Wesley et al., "Construct design for efficient, effective and high-throughput gene silencing in plants," *Plant J.* 27: 581-590 (2001).

Van der Krol et al., "An anti-sense chalcone synthase gene in transgenic plants inhibits flower pigmentation," (1988) *Nature* 333: 866-869.

Veena et al., "Glyoxalase I from *Brassica juncea*: molecular cloning, regulation and its over-expression confer tolerance in transgenic tobacco under stress," (1999). *Plant Journal* 17(4): 385-395.

Vaistij et al., "Spreading of RNA Targeting and DNA Methylation in RNA Silencing Requires Transcription of the Target Gene and a Putative RNA-Dependent RNA Polymerase," *Plant Cell* 14:857-867 (2002).

Xiong et al., "Different effects on ACC oxidase gene silencing triggered by RNA interference in transgenic tomato," *Plant Cell* 23:639-646 (2004).

Colliver et al., "Differential modification of flavonoid and isoflavonoid biosynthesis with an antisense chalcone synthase construct in transgenic *Lotus corniculatus*," *Plant Mol. Biol.*, 1997, 35(4):509-522.

Crookshanks et al., 28.8% identical, found in the EST Database. Accession No. BF153877 from The Potato tuber transcriptome: analysis of 6077 expressed sequence tags, *FEBS Lett.*, 2001, 506(2):123-126.

Falcón-Pérez et al., "Functional Domain Analysis of the Yeast ABC Transporter Ycf1p by Site-directed Mutagenesis," *J. Biol. Chem.*, 1999, 274(33):23584-23590.

Guo et al., "Protein Tolerance to Random Amino Acid Change," *Proc. Natl. Acad. Sci. USA*, 2004, 101(25):9205-9210.

Hill and Preiss, "Functional analysis of conserved histidines in ADP-glucose pyrophosphorylase from *Escerichia coli*," *Biochem. Biophys. Res. Commun.*, 1998, 244:573-577.

Jack et al., "Relative stability of nicotine to nomicotine conversion in three burley cultivars," *Coresta Congress*, 2004, Kyoto, Agro-Phyto groups, Abstract AP2.

Keskin et al., "A new, structurally nonredundant, diverse data set of protein-protein interfaces and its implications," *Protein Science*, 2004, 13:1043-1055.

Lazar et al., "Transforming Growth Factor α Mutation of Aspartic Acid 47 and Leucine 48 Results in Different Biological Activities," *Mol. Cell. Biol.*, 1988, 8(3):1247-1252.

Ralston et al., "Cloning, Heterologous Expression, and Functional Characterization of 5-*epi*-Aristolochene-1,3-Dihydroxylase from Tobacco (*Nicotiana tabacum*)," *Arch. Biochem. Biophys.*, 2001, 393(2):222-235.

Schenk et al., "Coordinated plant defense responses in *Arabidopsis* revealed by microarray analysis," *Proc. Natl. Acad. Sci. USA*, 2000, 97(21):11655-11660.

Thornton et al., "From structure to function: Approaches and limitations," *Nature Structural Biology, Structural Genomics Supplement*, Nov. 2000, pp. 991-994.

Wernsman and Matzinger, "Relative Stability of Alleles at the Nicotine Conversion Locus of Tobacco," *Tobacco Sci.*, 1970, 14:34-36.

Plant Variety Protection Office (USDA-AMS, Beltsville, MD, http://www.ars-grin.gov/cgi-bin/npgs/html/pvp.pl?Tobbaco, accessed Feb. 2009).

ARS-GRIN (PI 551280, http://www.ars-grin.gov/cgi-bin/npgs/acc/display.pl?1446216, accessed Feb. 2009).

Ghosh, "Polyamines and plant alkaloids," *Indian J. Exp. Biol.*, 2000, 38:1086-1091.

Burton et al., "Distribution of Tobacco Constituents in Tobacco Leaf Tissue. 1. Tobacco-Specific Nitrosamines, Nitrate, Nitrite, and Alkaloids," *J. Agric. Food Chem.*, 1992, 40:1050-1055.

Chakrabarti et al., "Inactivation of the cytochrome P450 gene CYP82E2 by degenerative mutations was a key event in the evolution of the alkaloid profile of modern tobacco," *New Phytologist*, 2007, 175:565-574.

Gavilano et al., "Genetic Engineering of *Nicotiana tabacum* for Reduced Nornicotine Content," *J. Agric. Food Chem.*, 2006, 54:9071-9078.

Wagner et al., "Elucidation of the functions of genes central to diterpene metabolism in tobacco trichomes using posttranscriptional gene silencing," *Planta*, 2003, 216:686-691.

Batard et al., "Increasing Expression of P450 and P450-Reductase Proteins from Monocots in Heterologous Systems," *Arch. Biochem. Biophys.*, 2000, 379:161-169.

Wetmur, "DNA Probes: Applications of the Principles of Nucleic Acid Hybridization," *Crit. Rev. Biol. Mol. Biol.*, 1991, 26:227-259.

Tang et al., "Using RNAi to improve plant nutritional value: from mechanism to application," TRENDS in Biotechnology, 22(9):463-69 (2004).

\* cited by examiner

Genome Structure of 33-L
(Genomic Gene of D121-AA8)

Figure 4A: Amino Acid Identity of Group Members

Group 1
AQLAINLVTSMLGHLLHHFTWAPAPGVNPEDIDLEESPGTVTYMKNPIQAIPTPRLPAHLYGRVPVDM     SEQ ID No.:11D58-BG7
                          |                  (98.5)
AQLAINLVTSMLGHLLHHFTWAPPPGVNPENIDLEESPGTVTYMKNPIQAIPTPRLPAHLYGRVPVDM     SEQ ID No.:13D58-AB1

Group 2
QLAINLVTSMLGHLFIILHGLRPRGLTRRILTWRRALEQ     SEQ ID No.:17D58-BE4

Group 3
EGLAVRMVALSLGCIIQCFDWQRIGEELVDMTEGTGLTLPKAQPLVAKCSPRPKMANLLSQI     SEQ ID No.: 19D56-AH7
    |                     | |                      |             (93.5)
EGLAIRMVALSLGCIIQCFDWQRLGEGLVDKTEGTGLTLPKAQPLVAKCSPRPIMANLLSQI     SEQ ID No.:21 D13a-5

Group 4
IGFATLVTHLTFGRLLQGFDFSKPSNTPIDMTEGVGVTLPKVNQVEVLITPRLPSKLYLF     SEQ ID No.:23 D56-AG10
 |                |                         |    |         (93.3)
INFATLVTHLTFGRLLQGFDFSTPSNTPIDMTEGVGVTLPKVNQVEVLISPRLPSKLYVF     SEQ ID No.:27 D34-62

Group 5
IILALPILGITLGRLVQNFELLPPPGQSKLDTTEKGGQFSLHILKHSTIVLKPRSF     SEQ ID No.:29 D56-AA7
                                                |        (98.2)
IILALPILGITLGRLVQNFELLPPPGQSKLDTTEKGGQFSLHILKHSTIVMKPRSF     SEQ ID No.:153 D185-BD3
                                                | |      (96.4)
IILALPILGITLGRLVQNFELLPPPGQSKLDTTEKGGQFSLHILKHSTIVLKPRSC     SEQ ID No.:31 D56-AE1

Group 6
IALGVASMELALSNLLYAFDWELPFGMKKEDIDTNARPGITMHKKNELYLIPKNYL     SEQ ID No.:33 D35-BB7
                              | |        |            |           (92.8)
IALGVASMELALSNLLYAFDWELPYGVKKENIDTNVRPGITMHKKNELCLIPRNYL     SEQ ID No.:35 D177-BA7
                                                |           |      (96.4)
IALGVASMELALSNLLYAFDWELPYGVKKEDIDTNVRPGIAMHKKNELCLVPKNYL     SEQ ID No.:37 D56A-AB6
                                                          |||     (94.6)
IALGVASMELALSNLLYAFDWELPYGVKKEDIDTNVRPGIAMHKKNELCLVPKKLFINYIGTWISC     SEQ ID No.:39 D144-AE2

Group 7
ISFGLANAYLPLAQLLYHFDWELPTGIKPSDLDLTELVGVTAARKSDLYLVATPYQPPQN     SEQ ID No.:41 D56-AG11
                          | | |                                 |     (93.3)
ISFGLANAYLPLAQLLYHFDWKLPAGIEPSDLDLTELVGVTAARKSDLYLVATPYQPPQK     SEQ ID No.:43 D179-AA1

Group 8
MLFGLANVGQPLAQLLYHFDWKLPNGQSHENFDMTESPGISATRKDDLVLIATPYDSY     SEQ ID No.:45 D56-AC7
                        | |                    |    ||      (91.2)
MLFGLANVGQPLAQLLYHFDWKLPNGQTHQNFDMTESPGISATRKDDLILIATPAHS     SEQ ID No.:47 D144-AD1

Figure 4B

Group 9

| | |
|---|---|
| LLFGLVNVGHPLAQLLYHFDWKTLPGISSDSFDMTETDGVTAGRKDDLCLIATPFGLN | SEQ ID No.:49 D144-AB5 |

Group 10

| | |
|---|---|
| MSFGLVNTGHPLAQLLYFFDWKFPHKVNAADFHTTETSRVFAASKDDLYLIPTNHMEQE | SEQ ID No.:51 D181-AB5 |
|                                                                                            | (89.8) |
| MSFGLVNTGHPLAQLLYCFDWKLPDKVNANDFRTTETSRVFAASKDDLYLIPTNHREQE | SEQ ID No.:53 D73-Ac9 |

Group 11

| | |
|---|---|
| MQFGLALVTLPLAHLLHNFDWKLPEGINARDLDMTEANGISARREKDLYLIATPYVSPLD | SEQ ID No.:55 D56-AC12 |

Group 12

| | |
|---|---|
| MTYALQVEHLTMAHLIQGFNYRTPTDEPLDMKEGAGITIRKVNPVKVIITPRLAPELY | SEQ ID No.:57 D58-AB9 |
| | (89.6) |
| MTYALQVEHLTMAHLIQGFNYRTPNDEALDMKEGAGITIRKVNPVELIIAPRLAPELY | SEQ ID No.:59 D56-AG9 |
| | (98.2) |
| MTYALQVEHLTMAHLIQGFNYRTPNDEALDMKEGAGITIRKVNPVELIITPRLAPELY | SEQ ID No.:61 D56-AG6 |
| | (94.8) |
| MTYALQVEHLTMAHLIQGFNYRTPNDEPLDMKEGAGITIRKVNPVELIIAPRLAPELY | SEQ ID No.:63 D35-BG11 |
| | (98.3) |
| MTYALQVEHLTMAHLIQGFNYRTPNDEPLDMKEGAGITIRKVNPVELIIAP-LAPELY | SEQ ID No.:65 D35-42 |
| | (98.3) |
| MTYALQVEHLTMAHLIQGFNYRTPNDEPLDMKEGAGITIRKVNPAELIIAPRLAPELY | SEQ ID No.:67 D35-BA3 |
| | (84.5) |
| MTYALQVEHLTIAHLIQGFNYKTPNDEPLDMKEGAGLTIRKVNPVEVTTTARLAPELY | SEQ ID No.:69 D34-57 |
| | (98.3) |
| MTYALQVEHLTIAHLIQGFNYKTPNDEPLDMKEGAGLTIRKVNPVEVTITARLAPELY | SEQ ID No.:71 D34-52 |

Group 13

| | |
|---|---|
| YSLGLKVIRVTLANMLHGFNWKLPEGMKPEDISVEEHYGLTTHPKFPVPVILESRLSSDLYSPIT | SEQ ID No.:75 D56-AD10 |

Group 14

| | |
|---|---|
| YSLGIRIIRATLANLLHGFNWRLPNGMSPEDISMEEIYGLITHPKVALDVMMEPRLPNHLYK | SEQ ID No.:77 D56-AA11 |

Group 15

| | |
|---|---|
| INFSIPLVELALANLLFHYNWSLPEGMLAKDVDMEEALGITMHKKSPLCLVASHYTC | SEQ ID No.:79 D177-BD5 |
| | (94.7) |
| INFSIPLVELALANLLFHYNWSLPEGMLPKDVDMEEALGITMHKKSPLCLVASHYNLL | SEQ ID No.:93 D177-BD7 |

Group 16

| | |
|---|---|
| MQLGLYALEMAVAHLLLCFTWELPDGMKPSELKMDDIFGLTAPRANRLVAVPSPRLLCPLY | SEQ ID No.:83 D58-BC5 |
| | (96.7) |
| MQLGLYALEMAVAHLLHCFTWELPDGMKPSELKMDDIFGLTAPRANRLVAVPTPRLLCPLY | SEQ ID No.:85 D58-AD12 |
| | (98.4) |
| MQLGLYALEMAVAHLLHCFTWELPDGMKPSELKMDDIFGLTAPKANRLVAVPTPRLLCPLY | SEQ ID No.:81 D56A-AG10 |

Group 17

| | |
|---|---|
| MLWSASIVRVSYLTCIYRFQVYAGSVFRVA | SEQ ID No.:87 D56-AC11 |

Figure 4C

MLWSASIVRVSYLTCIYRFQVYAGSVSRVA  (96.7) SEQ ID No.:97 D56-AD6F

Group 18

LNFAMLEAKMALALILQHYAFELSPSYAHAPHTIITLQPQHGAPLILRKL  SEQ ID No.:99 D73A-AD6

Group 19

QNFAILEAKMAIAMILQRFSFELSPSYTHSPYTVVTLKPKYGAPLIMHRL  SEQ ID No.:105 D70A-AB5
  |   ||         | | |||| || |    | |  (72.0)
QNFAMLEAKMALSMILQRFSFELSPSYAHAPQSILTVQPQYGAPLIFHKL  SEQ ID No.:109 D70A-AB8
  |   |   ||       |     |||    |  (82.0)
INFAMTEAKMAMAMILQRFSFELSPSYTHAPQSVITMQPQYGAPLILHKL  SEQ ID No.:111 D70A-BH2
  |  (98.0)
INFAMAEAKMAMAMILQRFSFELSPSYTHAPQSVITMQPQYGAPLILHKL  SEQ ID No.:113 D70A-AA4
  |   |   |   ||       |||| ||    ||||  (70.0)
QNFAMMEAKMAVAMILHKFSFELSPSYTHAPFAIVTIHPQYGAPLLMRRL  SEQ ID No.:117 D70A-BA9
  |  (98.0)
QNFAMMEAKMAVAMILQKFSFELSPSYTHAPFAIVTIHPQYGAPLLMRRL  SEQ ID No.:115 D70A-BA1

Group 20

QNFAMLEAKMAMAMILKTYAFELSPSYAHAPHPLLLQPQYGAQLILYKL  SEQ ID No.:119 D70A-BD4

Group 21

YSMGLKAIQASLANLLHGFNWSLPDNMTPEDLNMDEIFGLSTPKKFPLATVIEPRLSPKLYSV  SEQ ID No.:121 D181-AC5
  |  | (96.8)
YSLGLKEIQASLANLLHGFNWSLPDNMTPEDLNMDEIFGLSTPKKFPLATVIEPRLSPKLYSV  SEQ ID No.:123 D144-AH1
  |   | (96.8)
HSLGLKVIQASLANLLHGFNWSLPDNMTPEDLNMDEIFGLSTPKKFPLATVIEPRLSPKLYSV  SEQ ID No.:125 D34-65

Group 22

LCFPCLISSYILALNVNLYHNFLQISPSISY  SEQ ID No.:127 D35-BG2

Group 23

SGLAQCVVGLALATLVQCFEWKRVSEEVVDLTEGKGLTMPKPEPLMARCEARDIFHKVLSEIS  SEQ ID No.:129 D73A-AH7

Group 24

LGLATVHVNLMLARMIQEFEWSAYPENRKVDLLRNWNLLW  SEQ ID No.:145 D185-BG2
                  ||||||||  (77.5)
LGLATVHVNLMLARMIQEFEWSAYPENRKVDFTEKLEFTVVMKNPLRAKVKPRMQVV  SEQ ID No.:131 D58-AA1
                  |  (98.2)
LGLATVHVNLMLARTIQEFEWSAYPENRKVDFTEKLEFTVVMKNPLRAKVKPRMQVV  SEQ ID No.:143 D185-BC1

ALIGNMENT OF GROUP 1

```
D58-BG7    GCACAACTTGCTATCAACTTGGTCACATCTATGTTGGGTCATTTGTTGCATCATTTTACA  SEQ ID NO 10
D58-AB1    GCACAACTTGCTATCAACTTGGTCACATCTATGTTGGGTCATTTGTTGCATCATTTTACG  SEQ ID NO 12
D58-BE4    GCACAACTTGCTATCAACTTGGTCACATCTATGTTGGGTCATTTGTT-CATCATTTTACA  SEQ ID NO 16
           ************************************************ ***********

D58-BG7    TGGGCTCCGGCCCCGGGGGTTAACCCGGAGGATATTGACTTGGAGGAGAGCCCTGGAACA
D58-AB1    TGGGCTCCGCCCCCGGGGGTTAACCCGGAGAATATTGACTTGGAGGAGAGCCCTGGAACA
D58-BE4    TGGGCTCCGGCCCCGGGGGTTAACCCGGAGGATATTGACTTGGAGGAGAGCCCTGGAACA
           ********  ********************  ****************************

D58-BG7    GTAACTTACATGAAAAATCCAATACAAGCTATTCCAACTCCAAGATTGCCTGCACACTTG
D58-AB1    GTAACTTACATGAAAAATCCAATACAAGCTATTCCTACTCCAAGATTGCCTGCACACTTG]
           |||||||||||||||||||||||||||||||||||||||||||||||||||||||||||
D58-BE4    GTAACTTACATGA-----------------------------------------------
           *************

D58-BG7    TATGGACGTGTGCCAGTGGATATGTAA
D58-AB1    TATGGACGTGTGCCAGTGGATATGTAA
           |||||||||||||||||||||||||||
D58-BE4    ---------------------------
```

PERCENT IDENTITY OF GROUP 1

|         | D58-BG7 | D58-BE4 | D58-AB1 |            |
|---------|---------|---------|---------|------------|
| D58-BG7 | ***     | 96.2    | 98.1    | SEQ ID NO 10 |
| D58-BE4 |         | ***     | 94.0    | SEQ ID NO 16 |
| D58-AB1 |         |         | ***     | SEQ ID NO 12 |

ALIGNMENT OF GROUP 2

```
D56-AH7    GAAGGATTGGCTGTTCGAATGGTTGCCTTGTCATTGGGATGTATTATTCAATGTTTTGAT  SEQ ID NO 18
D13a-5     GAAGGATTGGCTATTCGAATGGTTGCATTGTCATTGGGATGTATTATTCAATGCTTTGAT  SEQ ID NO 20
           ************ ************ *************************** ******

D56-AH7    TGGCAACGAATCGGCGAAGAATTGGTTGATATGACTGAAGGAACTGGACTTACTTTGCCT
D13a-5     TGGCAACGACTTGGGGAAGGATTGGTTGATAAGACTGAAGGAACTGGACTTACTTTGCCT
           *********  **  **** ********** *****************************

D56-AH7    AAAGCTCAACCTTTGGTGGCCAAGTGTAGCCCACGACCTAAAATGGCTAATCTTCTCTCT
D13a-5     AAAGCTCAACCTTTAGTGGCCAAGTGTAGCCCACGACCTATAATGGCTAATCTTCTTTCT
           ************** ************************ **************** ***

D56-AH7    CAGATTTGA
D13a-5     CAGATTTGA
           *********
```

PERCENT IDENTITY OF GROUP 2

|         | D56-AH7 | D13a-5 |            |
|---------|---------|--------|------------|
| D56-AH7 | ***     | 93.7   | SEQ ID NO 18 |
| D13a-5  |         | ***    | SEQ ID NO 20 |

Figure 5A

ALIGNMENT OF GROUP 3

```
D56-AG10   ATAGGTTTTGCGACTTTAGTGACACATCTGACTTTTGGTCGCTTGCTTCAAGGTTTTGAT   SEQ ID NO 22
                |
D35-33     ATAGGCTTTGCGACTTTAGTGACACATCTGACTTTTGGTCGCTTGCTTCAAGGTTTTGAT   SEQ ID NO 24
               |||
D34-62     ATAAATTTTGCGACTTTAGTGACACATCTGACTTTTGGTCGCTTGCTTCAAGGTTTTGAT   SEQ ID NO 26
           ***    *****************************************************

D56-AG10   TTTAGTAAGCCATCAAACACGCCAATTGACATGACAGAAGGCGTAGGCGTTACTTTGCCT

D35-33     TTTAGTAAGCCATCAAACACGCCAATTGACATGACAGAAGGCGTAGGCGTTACTTTGCCT
                 |                     |
D34-62     TTTAGTACGCCATCAAACACGCCAATAGACATGACAGAAGGCGTAGGCGTTACTTTGCCT
           ******* ***************** **********************************

D56-AG10   AAGGTTAATCAAGTTGAAGTTCTAATTACCCCTCGTTTACCTTCTAAGCTTTATTTATTTTGA
                                                                    ||
D35-33     AAGGTTAATCAAGTTGAAGTTCTAATTACCCCTCGTTTACCTTCTAAGCTTTATTTAT-----
                |      |         |                                |  ||
D34-62     AAGGTAAATCAAGTGGAAGTTCTAATTAGCCCTCGTTTACCTTCTAAGCTTTATGTATTCTGA
           ***** ******** ************* ************************* ***
```

PERCENT IDENTITY OF GROUP 3

|          | D56-AG10 | D35-33 | D34-62 |          |
|----------|----------|--------|--------|----------|
| D56-AG10 | ***      | 98.9   | 95.1   | SEQ ID NO 22 |
| D35-33   |          | ***    | 94.4   | SEQ ID NO 24 |
| D34-62   |          |        | ***    | SEQ ID NO 26 |

ALIGNMENT OF GROUP 4

```
D56-AA7    ATTATACTTGCATTGCCAATTCTTGGCATCACTTTGGGACGTTTGGTTCAGAACTTTGAG   SEQ ID NO 28
                                         |
D56-AE1    ATTATACTTGCATTGCCAATTCTTGGCATTACTTTGGGACGTTTGGTTCAGAACTTTGAG   SEQ ID NO 30
               |    |                 |        |   |
D185-BD3   ATTATCCTTGCACTGCCAATTCTTGGCATTACCTTGGGACGCTTGGTGCAGAACTTTGAG   SEQ ID NO 152
           ***** ****** *************** ** ******** ***** ************

D56-AA7    CTGTTGCCTCCTCCAGGCCAGTCGAAGCTCGACACCACAGAGAAAGGTGGACAGTTCAGT

D56-AE1    CTGTTGCCTCCTCCAGGCCAGTCGAAGCTCGACACCACAGAGAAAGGTGGACAGTTCAGT
              |                    |    |     |  |       |     |
D185-BD3   TTGTTGCCTCCTCCAGGACAGTCAAAGCTTGACACAACAGAGAAAGGCGGGCAATTCAGT
            **************** ****** ***** ***** *********** ** ** ******

D56-AA7    CTCCACATTTTGAAGCATTCCACCATTGTGTTGAAACCAAGGTCTTTCTGA
               |
D56-AE1    CTCCATATTTTGAAGCATTCCACCATTGTGTTGAAACCAAGGTCTTGCTGA
             |  |                                      |  ||
D185-BD3   CTGCACATTTTGAAGCATTCCACCATTGTGATGAAACCAAGATCTTTTTAA
           ** ** ************************ ********* *****   * *
```

PERCENT IDENTITY OF GROUP 4

|          | D56AA7 | D56-AE1 | D185-BD3 |              |
|----------|--------|---------|----------|--------------|
| D56AA7   | ***    | 98.2    | 87.7     | SEQ ID NO 28 |
| D56-AE1  |        | ***     | 87.1     | SEQ ID NO 30 |
| D185-BD3 |        |         | ***      | SEQ ID NO 152 |

Figure 5B

ALIGNMENT OF GROUP 5

```
D56A-AB6    ATTGCACTTGGGGTTGCATCCATGGAACTTGCTTTGTCAAATCTTCTTTATGCATTTGAT   SEQ ID NO 36
D35-BB7     ATTGCACTTGGGGTTGCATCAATGGAACTTGCATTGTCAAATCTTCTTTATGCATTTGAT   SEQ ID NO 32
D177-BA7    ATTGCACTTGGGGTTGCATCCATGGAACTTGCTTTGTCAAATCTTCTTTATGCATTTGAT   SEQ ID NO 34
D144-AE2    ATTGCACTTGGGGTTGCATCCATGGAACTTGCTTTGTCAAATCTTCTTTATGCATTTGAT   SEQ ID NO 38

D56A-AB6    TGGGAGTTGCCTTATGGAGTGAAAAAAGAAGACATCGACACAAACGTTAGGCCTGGAATT
D35-BB7     TGGGAGTTACCTTTTGGAATGAAAAAAGAAGACATTGACACAAACGCCAGGCCTGGAATT
D177-BA7    TGGGAGTTACCTTACGGAGTGAAAAAAGAAAACATTGACACAAATGTCAGGCCTGGAATT
D144-AE2    TGGGAGTTGCCTTATGGAGTGAAAAAAGAAGACATCGACACAAACGTTAGGCCTGGAATT

D56A-AB6    GCCATGCACAAGAAAAACGAACTTTGCCTTGTCCCAAAAAA-TTATTTATAA------
D35-BB7     ACCATGCATAAGAAAAACGAACTTTATCTTATCCCTAAAAA-TTATCTATAG-----
D177-BA7    ACCATGCATAAGAAAAACGAACTTTGCCTTATCCCTAGAAA-TTATCTATAG------
D144-AE2    GCCATGCACAAGAAAAACGAACTTTGCCTTGTCCCAAAAAAATTATTTATAAATTAT

D56A-AB6    ------------------------
D35-BB7     ------------------------
D177-BA7    ------------------------
D144-AE2    ATTGGGACGTGGATCTCATGCTAG
```

PERCENT IDENTITY OF GROUP 5

|          | D56A-AB6 | D35-BB7 | D144-AE2 | D177-BA7 |           |
|----------|----------|---------|----------|----------|-----------|
| D56A-AB6 | ***      | 90.6    | 97.1     | 91.8     | SEQ ID NO 36 |
| D35-BB7  |          | ***     | 87.7     | 93.0     | SEQ ID NO 32 |
| D144-AE2 |          |         | ***      | 88.9     | SEQ ID NO 38 |
| D177-BA7 |          |         |          | ***      | SEQ ID NO 34 |

ALIGNMENT OF GROUP 6

```
D56-AG11    ATTTCGTTTGGTTTAGCTAATGCTTATTTGCCATTGGCTCAATTACTTTATCACTTTGAT   SEQ ID NO 40
D179-AA1    ATTTCGTTTGGCTTAGCTAATGCTTATTTGCCATTGGCTCAATTACTATATCACTTCGAT   SEQ ID NO 42

D56-AG11    TGGAACTCCCCACTGGAATCAAACCAAGCGACTTGGACTTGACTGAGTTGGTTGGAGTA
D179-AA1    TGGAAACTCCCTGCTGGAATCGAACCAAGCGACTTGGACTTGACTGAGTTGGTTGGAGTA

D56-AG11    ACTGCCGCTAGAAAAAGTGACCTTTACTTGGTTGCGACTCCTTATCAACCTCCTCAAAACTGA
D179-AA1    ACTGCCGCTAGAAAAAGTGACCTTTACTTGGTTGCGACTCCTTATCAACCTCCTCAAAAGTGA
```

PERCENT IDENTITY OF GROUP 6

|          | SEQ ID NO 40 | SEQ ID NO 42 |              |
|----------|--------------|--------------|--------------|
|          | D56-AG11     | D179-AA1     |              |
| D56-AG11 | ***          | 95.6         | SEQ ID NO 40 |
| D179-AA1 |              | ***          | SEQ ID NO 42 |

Figure 5C

ALIGNMENT OF GROUP 7

```
D56-AC7     ATGCTATTTGGTTTAGCTAATGTTGGACAACCTTTAGCTCAGTTACTTTATCACTTCGAT   SEQ ID NO 44

D144-AD1    ATGCTATTTGGTTTAGCTAATGTTGGACAACCTTTAGCTCAGTTACTTTATCACTTCGAT   SEQ ID NO 46
            ************************************************************

D56-AC7     TGGAAACTCCCTAATGGACAAAGTCATGAGAATTTCGACATGACTGAGTCACCTGGAATT
                                 |   ||| |
D144-AD1    TGGAAACTCCCTAATGGACAAACTCACCAAAATTTCGACATGACTGAGTCACCTGGAATT
            ********************* *** * ********************************

D56-AC7     TCTGCTACAAGAAAGGATGATCTTGTTTTGATTGCCACTCCTTATGATTCTTATTAA
                                 |         |||
D144-AD1    TCTGCTACAAGAAAGGATGATCTTATTTTGATTGCCACTCCTGCTCATTCTTGA
            ************************ ***************** * ******
```

PERCENT IDENTITY OF GROUP 7

|          | D144-AD1 | D56-AC7 |              |
|----------|----------|---------|--------------|
| D144-AD1 | ***      | 94.3    | SEQ ID NO 46 |
| D56-AC7F |          | ***     | SEQ ID NO 44 |

ALIGNMENT OF GROUP 9

```
D181-AB5    ATGTCGTTTGGTTTAGTTAACACTGGGCATCCTTTAGCTCAGTTGCTCTATTTCTTTGAC   SEQ ID NO 50
                                  |            |          !
D73-AC9     ATGTCGTTTGGTTTAGTTAACACAGGGCATCCTTTAGCCCAGTTGCTCTATTGCTTTGAC   SEQ ID NO 52
            ********************** ************** ************* *******

D181-AB5    TGGAAATTCCCTCATAAGGTTAATGCAGCTGATTTTCACACTACTGAAACAAGTAGAGTT
                  |    |  *    ||           ||    |
D73-AC9     TGGAAACTCCCTGACAAGGTTAATGCAAATGATTTTCGCACTACTGAAACAAGTAGAGTT
            ****** ***** * *********** * ******** **********************

D181-AB5    TTTGCAGCAAGCAAAGATGACCTCTACTTGATTCCAACAAATCACATGGAGCAAGAGTAG
                                                    |        |        |
D73-AC9     TTTGCAGCAAGCAAAGATGACCTCTACTTGATTCCCACAAATCACAGGGAGCAAGAATAG
            *********************************** ********** ********* ***
```

PERCENT IDENTITY OF GROUP 9

|         | D181-AB5 | D73-AC9 |              |
|---------|----------|---------|--------------|
| D181-AB5 | ***     | 92.8    | SEQ ID NO 50 |
| D73-AC9  |         | ***     | SEQ ID NO 52 |

Figure 5D

ALIGNMENT OF GROUP 11

```
D58-AB9    ATGACTTATGCATTGCAAGTGGAACACCTAACAATGGCACATTTGATCCAGGGTTTCAAT    SEQ ID NO 56
D56-AG9    ATGACTTATGCATTGCAAGTGGAACACCTAACAATGGCACATTTAATCCAGGGTTTCAAT    SEQ ID NO 58
D35-BG11   ATGACTTATGCATTGCAAGTGGAACACTTAACAATGGCACATTTGATCCAAGGTTTCAAT    SEQ ID NO 62
D34-25     ATGACTTATGCATTACAAGTGGAACACCTAACAATAGCACATTTGATCCAGGGTTTCAAT    SEQ ID NO 72
D35-BA3    ATGACTTATGCATTGCAAGTGGAACACTTAACAATGGCACATTTGATCCAAGGTTTCAAT    SEQ ID NO 66
D34-52     ATGACTTATGCATTACAAGTGGAACACCTAACAATAGCACATTTGATCCAGGGTTTCAAT    SEQ ID NO 70
D56-AG6    ATGACTTATGCATTGCAAGTGGAACACCTAACAATGGCACATTTAATCCAGGGTTTCAAT    SEQ ID NO 60
D35-42     ATGACTTATGCATTGCAAGTGGAACACTTAACAATGGCACATTTGATCCAAGGTTTCAAT    SEQ ID NO 64
D34-57     ATGACTTATGCATTACAAGTGGAACACCTAACAATAGCACATTTGATCCAGGGTTTCAAT    SEQ ID NO 68

D58-AB9    TACAGAACTCCAACTGATGAGCCCTTGGATATGAAAGAAGGTGCAGGCATAACTATACGT
D56-AG9    TACAAAACTCCAAATGACGAGGCCTTGGATATGAAGGAAGGTGCAGGCATAACTATACGT
D35-BG11   TACAGAACTCCAAATGACGAGCCCTTGGATATGAAGGAAGGTGCAGGCATAACTATACGT
D34-25     TACAAAACTCCAAATGACGAGCCCCTGGATATGAAGGAAGGTGCAGGATTAACTATACGT
D35-BA3    TACAGAACTCCAAATGACGAGCCCTTGGATATGAAGGAAGGTGCAGGCATAACTATACGT
D34-52     TACAAAACTCCAAATGACGAGCCCTTGGATATGAAGGAAGGTGCAGGATTAACTATACGT
D56-AG6    TACAAAACTCCAAATGACGAGGCCTTGGATATGAAGGAAGGTGCAGGCATAACAATACGT
D35-42     TACAGAACTCCAAATGACGAGCCCTTGGATATGAAGGAAGGTGCAGGCATAACTATACGT
D34-57     TACAAAACTCCAAATGACGAGCCCTTGGATATGAAGGAAGGTGCAGGATTAACCATACGT

D58-AB9    AAGGTAAATCCTGTGAAAGTGATAATTACGCCTCGCTTGGCACCTGAGCTTTATTAA
D56-AG9    AAGGTAAATCCTGTGGAACTGATAATAGCGCCTCGCCTGGCACCTGAGCTTTATTAA
D35-BG11   AAGGTAAATCCTGTGGAACTGATAATAGCGCCTCGCCTGGCACCTGAGCTTTATTAA
D34-25     AAAGTAAATCCTGTAGAAGTGACAATTACGGCTCGCCTGGCACCTGAGCTTTATTAA
D35-BA3    AAGGTAAATCCTGCGGAACTGATAATAGCGCCTCGCCTGGCACCTGAGCTTTATTAA
D34-52     AAAGTAAATCCTGTAGAAGTGACAATTACGGCTCGCCTGGCACCTGAGCTTTATTAA
D56-AG6    AAGGTAAATCCAGTGGAATTGATAATAACGCCTCGCTTGGCACCTGAGCTTTACTAA
D35-42     AAGGTAAATCCTGTGGAACTGATAATAGCGCCCC---TGGCACCTGAGCTTTATTAA
D34-57     AAAGTAAATCCTGTAGAAGTGACAACTACGGCTCGCCTGGCACCTGAGCTTTATTAA
```

PERCENT IDENTITY OF GROUP 11

|        | D58-AB9 | D56-AG9 | D56-AG6 | D35-BG11 | D35-42 | D35-BA3 | D34-57 | D34-52 | D34-25 |         |
|--------|---------|---------|---------|----------|--------|---------|--------|--------|--------|---------|
| D58-AB9 | ***    | 93.8    | 93.2    | 94.3     | 90.8   | 93.2    | 90.9   | 92.0   | 91.5   | SEQ ID NO 56 |
| D56-AG9 |         | ***     | 96.6    | 97.2     | 94.2   | 96.6    | 91.5   | 92.6   | 92.0   | SEQ ID NO 58 |
| D56-AG6 |         |         | ***     | 93.8     | 90.2   | 92.6    | 90.3   | 90.9   | 90.3   | SEQ ID NO 60 |
| D35-BG11 |        |         |         | ***      | 97.1   | 99.4    | 90.9   | 92.0   | 91.5   | SEQ ID NO 62 |
| D35-42  |         |         |         |          | ***    | 96.5    | 87.3   | 88.4   | 87.9   | SEQ ID NO 64 |
| D35-BA3 |         |         |         |          |        | ***     | 90.3   | 91.5   | 90.9   | SEQ ID NO 66 |
| D34-57  |         |         |         |          |        |         | ***    | 98.9   | 98.3   | SEQ ID NO 68 |
| D34-52  |         |         |         |          |        |         |        | ***    | 99.4   | SEQ ID NO 70 |
| D34-25  |         |         |         |          |        |         |        |        | ***    | SEQ ID NO 72 |

Figure 5E

ALIGNMENT OF GROUP 14

```
D177-BD7    ATTAATTTTTCAATACCACTTGTTGAGCTTGCACTTGCTAATCTATTGTTTCATTATAAT    SEQ ID NO 92

D177-BD5    ATTAATTTTTCAATACCACTTGTTGAGCTTGCACTTGCTAATCTATTGTTTCATTATAAT    SEQ ID NO 78
            ************************************************************

D177-BD7    TGGTCACTTCCTGAGGGGATGCTACCTAAGGATGTTGATATGGAAGAAGCTTTGGGGATT
                          |             |         \
D177-BD5    TGGTCACTTCCTGAAGGGATGCTAGCTAAGGATGTTGATATGGAAGAAGCTTTGGGGATT
            **************  ********  **********************************

D177-BD7    ACCATGCACAAGAAATCTCCCCTTTGCTTAGTAGCTTCTCATTATAAACTTGTTGTGA
                                                         |       |||
D177-BD5    ACCATGCACAAGAAATCTCCCCTTTGCTTAGTAGCTTCTCATTATA-CTTGTTGA--
            **********************************************  *******
```

PERCENT IDENTITY OF GROUP 14

|           | D177-BD7 | D177-BD5 |              |
|-----------|----------|----------|--------------|
| D177-BD7  | ***      | 96.0     | SEQ ID NO 92 |
| D177-BD5  |          | ***      | SEQ ID NO 78 |

ALIGNMENT OF GROUP 15

```
D56A-AG10   ATGCAACTTGGGCTTTATGCATTGGAAATGGCTGTGGCCCATCTTCTTCATTGTTTTACT    SEQ ID NO 80

D58-AD12    ATGCAACTTGGGCTTTATGCATTGGAAATGGCTGTGGCCCATCTTCTTCATTGTTTTACT    SEQ ID NO 84
                                     |        |                |    |
D58-BC5     ATGCAACTTGGGCTTTATGCATTAGAAATGGCAGTGGCCCATCTTCTTCTTTGCTTTACT    SEQ ID NO 82
            ***********************  ******* ****************   *  *****

D56A-AG10   TGGGAATTGCCAGATGGTATGAAACCAAGTGAGCTTAAAATGGATGATATTTTTGGACTC

D58-AD12    TGGGAATTGCCAGATGGTATGAAACCAAGTGAGCTTAAAATGGATGATATTTTTGGACTC

D58-BC5     TGGGAATTGCCAGATGGTATGAAACCAAGTGAGCTTAAAATGGATGATATTTTTGGACTC
            ************************************************************

D56A-AG10   ACTGCTCCAAAAGCTAATCGACTCGTGGCTGTGCCTACTCCACGTTTGTTGTGTCCCCTT
                      |
D58-AD12    ACTGCTCCAAGAGCTAATCGACTCGTGGCTGTGCCTACTCCACGTTTGTTGTGTCCCCTT
                      |                                       |   |
D58-BC5     ACTGCTCCAAGAGCTAATCGACTCGTGGCTGTGCCTAGTCCACGTTTGTTGTGCCCACTT
            **********  *************************  ************** *  ***

D56A-AG10   TATTAA

D58-AD12    TATTAA

D58-BC5     TATTAA
            ******
```

PERCENT IDENTITY OF GROUP 15

|           | D56A-AG10 | D58-AD12 | D58-BC5 |              |
|-----------|-----------|----------|---------|--------------|
| D56A-AG10 | ***       | 99.5     | 95.7    | SEQ ID NO 80 |
| D58-AD12  |           | ***      | 96.2    | SEQ ID NO 84 |
| D58-BC5   |           |          | ***     | SEQ ID NO 82 |

Figure 5F

ALIGNMENT OF GROUP 16

```
D56-AD6    ATGCTTTGGAGTGCGAGTATAGTGCGCGTCAGCTACCTAACTTGTATTTATAGATTCCAA    SEQ ID NO 96
D56-AC11   ATGCTTTGGAGTGCGAGTATAGTGCGCGTCAGCTACCTAACTTGTATTTATAGATTCCAA    SEQ ID NO 86
D35-39     ATGCTTTGGAGTGCGAGTATAGTGCGCGTCAGCTACCTAACTTGTATTTATAGATTCCAA    SEQ ID NO 88
D58-BH4    ATGCTTTGGAGTGCGAGTATAGTGCGCGTCAGCTACCTAACCTGTATTTATAGATTCCAA    SEQ ID NO 90

D56-AD6    GTATATGCTGGGTCTGTGTCCAGAGTAGCATGA
D56-AC11   GTATATGCTGGGTCTGTGTTCAGAGTAGCATGA
D35-39     GTATATGCTGGGTCTGTGTTCAGAGTAGCATGA
D58-BH4    GTATATGCTGGGTCTGTGTTCAGAGTAGCATGA
```

PERCENT IDENTITY OF GROUP 16

|          | D56-AC11 | D56-AD6 | D58-BH4 | D35-39 |              |
|----------|----------|---------|---------|--------|--------------|
| D56-AC11 | ***      | 98.7    | 98.7    | 98.7   | SEQ ID NO 86 |
| D56-AD6  |          | ***     | 98.7    | 98.7   | SEQ ID NO 96 |
| D58-BH4  |          |         | ***     | 98.7   | SEQ ID NO 90 |
| D35-39   |          |         |         | ***    | SEQ ID NO 88 |

ALIGNMENT OF GROUP 17

```
D73A-AD6   CTGAATTTTGCAATGTTAGAGGCAAAAATGGCACTTGCATTGATTCTACAACACTATGCT    SEQ ID NO 98
D70A-BA11  CTGAATTTTGCAATGTTAGAGGCAAAAATGGCACTTGCATTGATTCTACAACACTATGCT    SEQ ID NO 100

D73A-AD6   TTTGAGCTCTCTCCATCTTATGCACATGCTCCTCATACAATTATCACTCTGCAACCTCAA
D70A-BA11  TTTGAGCTCTCTCCATCTTATGCACACGCTCCTCATACAATTATCACTCTGCAACCTCAA

D73A-AD6   CATGGTGCTCCTTTGATTTTGCGCAAGCTGTAG
D70A-BA11  CATGGTGCTCCTTTGATTTTGCGCAAGCTGTAG
```

PERCENT IDENTITY OF GROUP 17

|           | D73A-AD | 70A-BA11 |              |
|-----------|---------|----------|--------------|
| D73A-AD6  | ***     | 99.3     | SEQ ID NO 98 |
| D70A-BA11 |         | ***      | SEQ ID NO 100|

Figure 5G

ALIGNMENT OF GROUP 18

```
D70A-AB5    CAAAACTTCGCGATTTTGGAAGCAAAAATGGCTATAGCTATGATTCTACAACGCTTCTCC    SEQ ID NO 104
D70A-AA8    CAAAACTTCGCGATTTTGGAAGCAAAAATGGCTATAGCTATGATTCTACAACGCTTCTCC    SEQ ID NO 106
            ************************************************************

D70A-AB5    TTCGAGCTCTCCCCATCTTATACACACTCTCCATACACTGTGGTCACTTTGAAACCCAAA
                             |
D70A-AA8    TTCGAGCTCTCTCCATCTTATACACACTCTCCATACACTGTGGTCACTTTGAAACCCAAA
            *********** ************************************ **********

D70A-AB5    TATGGTGCTCCCCTAATAATGCACAGGCTGTAG
D70A-AA8    TATGGTGCTCCCCTAATAATGCACAGGCTGTAG
            *********************************
```

PERCENT IDENTITY OF GROUP 18

|          | D70A-AB5 | D70A-AA8 |              |
|----------|----------|----------|--------------|
| D70A-AB5 | ***      | 99.6     | SEQ ID NO 104 |
| D70A-AA8 |          | ***      | SEQ ID NO 106 |

ALIGNMENT OF GROUP 19

```
D70A-AB8    CAAAATTTTGCCATGTTAGAAGCAAAGATGGCTCTGTCTATGATCCTGCAACGCTTCTCT    SEQ ID NO 108
            ||   |    |   ||       |         | |    |       |        |
D70A-BH2    ATAAACTTTGCAATGACAGAAGCGAAGATGGCTATGGCTATGATTCTGCAACGCTTCTCC    SEQ ID NO 110
                     |
D70A-AA4    ATAAACTTTGCAATGGCAGAAGCGAAGATGGCTATGGCTATGATTCTGCAACGCTTCTCC    SEQ ID NO 112
            *** ***** *** ****** ********* ** ** ******* **************

D70A-AB8    TTTGAACTGTCTCCGTCTTATGCACATGCCCCTCAGTCCATATTAACCGT-CAGCCACAA
               | |    |    |  |       |       |  |    |  ||| | |
D70A-BH2    TTTGAGCTATCTCCATCTTACACACATGCTCCACAGTCTGTAATAACTATGCAACCCCAA
D70A-AA4    TTTGAGCTATCTCCATCTTACACACATGCTCCACAGTCTGTAATAACTATGCAACCCCAA
            ***** ** ***** ***** ******* ** ***** **  *****   *  ** * **

D70A-AB8    TATGGTGCTCCACTTATTTTCCACAAGCTATAA
                      | | |   ||| 
D70A-BH2    TATGGTGCTCCTCTTATATTGCACAAAATTGTAA
D70A-AA4    TATGGTGCTCCTCTTATATTGCACAAATTGTAA
            *********** ***** ** ** **   * **
```

PERCENT IDENTITY OF GROUP 19

|          | D70A-AB8 | D70A-AA4 | D70A-BH2 |              |
|----------|----------|----------|----------|--------------|
| D70A-AB8 | ***      | 77.8     | 77.8     | SEQ ID NO 108 |
| D70A-AA4 |          | ***      | 99.3     | SEQ ID NO 110 |
| D70A-BH2 |          |          | ***      | SEQ ID NO 112 |

Figure 5H

ALIGNMENT OF GROUP 20

| | | |
|---|---|---|
| D70A-BA1 | CAAAACTTTGCAATGATGGAAGCAAAAATGGCAGTAGCTATGATACTACAAAAATTTTCC | SEQ ID NO 114 |
| D70A-BA9 | CAAAACTTTGCAATGATGGAAGCAAAAATGGCAGTAGCTATGATACTACATAAATTTTCC | SEQ ID NO 116 |
| | ************************************************ ******** | |
| D70A-BA1 | TTTGAACTATCCCCTTCTTATACACATGCTCCATTTGCAATTGTGACTATTCATCCTCAG | |
| D70A-BA9 | TTTGAACTATCCCCTTCTTATACACATGCTCCATTTGCAATTGTGACTATTCATCCTCAG | |
| | ************************************************************ | |
| D70A-BA1 | TATGGTGCTCCTCTGCTTATGCGCAGACTTTAA | |
| D70A-BA9 | TATGGTGCTCCTCTGCTTATGCGCAGACTTTAA | |
| | ********************************* | |

PERCENT IDENTITY OF GROUP 20

| | D70A-BA1 | D70A-BA9 | |
|---|---|---|---|
| D70A-BA1 | *** | 99.4 | SEQ ID NO 114 |
| D70A-BA9 | | *** | SEQ ID NO 116 |

ALIGNMENT OF GROUP 22

| | | |
|---|---|---|
| D144-AH1 | TATAGCTTGGGGCTCAAGGAGATTCAAGCTAGCTTAGCTAATCTTCTACATGGATTTAAC | SEQ ID NO 122 |
| D34-65 | CATAGCTTGGGGCTCAAGGTGATTCAAGCTAGCTTAGCTAATCTTCTACATGGATTTAAC | SEQ ID NO 124 |
| D181-AC5 | TATAGCATGGGGCTCAAGGCGATTCAAGCTAGCTTAGCTAATCTTCTACATGGATTTAAC | SEQ ID NO 120 |
| | ***:**************  *************************************** | |
| D144-AH1 | TGGTCATTGCCTGATAATATGACTCCTGAGGACCTCAACATGGATGAGATTTTTGGGCTC | |
| D34-65 | TGGTCATTGCCTGATAATATGACTCCTGAGGACCTCAACATGGATGAGATTTTTGGGCTC | |
| D181-AC5 | TGGTCATTGCCTGATAATATGACTCCTGAGGACCTCAACATGGATGAGATTTTTGGGCTC | |
| | ************************************************************ | |
| D144-AH1 | TCTACACCTAAAAAATTCCACTTGCTACTGTGATTGAGCCAAGACTTTCACCAAAACTT | |
| D34-65 | TCTACACCTAAAAAATTCCACTTGCTACTGTGATTGAGCCAAGACTTTCACCAAAACTT | |
| D181-AC5 | TCTACACCTAAAAAATTCCACTTGCTACTGTGATTGAGCCAAGACTTTCACCAAAACTT | |
| | ************************************************************ | |
| D144-AH1 | TACTCTGTTTGA | |
| D34-65 | TACTCTGTTTGA | |
| D181-AC5 | TACTCTGTTTGA | |
| | ************ | |

PERCENT IDENTITY OF GROUP 22

| | D34-65 | D181-AC5 | D144-AH1 | |
|---|---|---|---|---|
| D34-65 | *** | 98.4 | 99.0 | SEQ ID NO 124 |
| D181-AC5 | | *** | 99.0 | SEQ ID NO 120 |
| D144-AH1 | | | *** | SEQ ID NO 122 |

Figure 5I

ALIGNMENT OF GROUP 25

```
D58-AA1    TTGGGCTTGGCAACGGTGCATGTGAATTTGATGTTGGCCCGAATGATTCAAGAATTTGAA    SEQ ID NO 130
D185-BC1   TTGGGCTTGGCAACGGTGCATGTGAATTTGATGTTGGCCCGAACGATTCAAGAATTTGAA    SEQ ID NO 142
D185-BG2   TTGGGCTTGGCAACGGTGCATGTGAATTTGATGTTGGCCCGAATGATTCAAGAATTTGAA    SEQ ID NO 144

D58-AA1    TGGTCCGCTTACCCGGAAAATAGGAAAGTGGATTTTACTGAGAAAATTGGAATTTACTGTG
D185-BC1   TGGTCCGCTTACCCGGAAAATAGGAAAGTGGATTTTACTGAGAAAATTGGAATTTACTGTG
D185-BG2   TGGTCCGCTTACCCGCAAAATAGGAAAGTGGATTT-ACTGAGAAATTGGAATTTACTGTG

D58-AA1    GTGATGAAAAATCCTTTAAGAGCTAAGGTCAAGCCAAGAATGCAAGTGGTGTAA
D185-BC1   GTGATGAAAAACCCTTTAAGAGCTAAGGTCAAGCCAAGAATGCAAGTGGTGTAA
D185-BG2   GTGA--------------------------------------------------
```

PERCENT IDENTITY OF GROUP 25

|         | D58-AA1 | D185-BG2 | D185-BC1 |           |
|---------|---------|----------|----------|-----------|
| D58-AA1 | ***     | 95.9     | 98.9     | SEQ ID NO 130 |
| D185-BG2 |        | ***      | 95.1     | SEQ ID NO 144 |
| D185-BC1 |        |          | ***      | SEQ ID NO 142 |

ALIGNMENT OF GROUP 28

```
D177-BF7   ATCACATTTGCTAAGTTTGTGAATGAGCTAGCATTGGCAAGATTAATGTTCCATTTTGAT    SEQ ID NO 136
D185-BD2   ATCACATTTGCTAAGTTTGTGAATGAGCTAGCATTGGCAAGATTAATGTTCCATTTTGAT    SEQ ID NO 148
D185-BE1   ATCACATTTGCTAAGTTTGTGAATGAGCTAGCATTGGCAAGATTAATGTTCCATTTTGAT    SEQ ID NO 146

D177-BF7   TTCTCGCTACCAAAAGGAGTTAAGCATGAGGATTTGGACGTGGAGGAAGCTGCTGGAATT
D185-BD2   TTCTCGCTACCAAAAGGAGTTAAGCATGCGGATTTGGACGTGGAGGAAGCTGCTGGAATT
D185-BE1   TTCTCGCTACCAAAAGGAGTTAAGCATGAGGATTTGGACGTGGAGGAAGCTGCTGGAATT

D177-BF7   ACTGTTAGAAGGAAGTTCCCCCTTTTAGCCGTCGCCACTCCATGCTCGTGA
D185-BD2   ACTGTTAGAAGGAAGTTCCCCCTTTTAGCCGTCGCCACTCCATGCTCGTGA
D185-BE1   ACTGTTAGGAGGAAGTTCCCCCTTTTAGCCGTCGCCACTCCATGCTCGTGA
```

PERCENT IDENTITY OF GROUP 28

|         | D177-BF7 | D185-BD2 | D185-BE1 |           |
|---------|----------|----------|----------|-----------|
| D177-BF7 | ***     | 99.4     | 99.4     | SEQ ID NO 136 |
| D185-BD2 |         | ***      | 98.8     | SEQ ID NO 148 |
| D185-BE1 |         |          | ***      | SEQ ID NO 146 |

Figure 5J

ALIGNMENT OF GROUP 30

```
D70A-AA12    ATGTCATTTGGTTTAGCTAATCTTTACTTACCATTGGCTCAATTACTCTATCACTTTGAC    SEQ ID NO 140
                || |||||||||| ||||| ||| || ||| ||||||||  || |||| ||||| |
D176-BF2     ATATCATTTGGTTTGGCTAATGTTTATTTGCCACTAGCTCAATTGTTATATCATTTTGAT    SEQ ID NO 94
             ** ************ ****** **** ** *** * ********  * ***** *****

D70A-AA12    TGGAAACTCCCAACCGGAATCAAGCCAAGAGACTTGGACTTGACCGAATTATCGGGAATA
             ||||||||||| || ||||||||  ||| || |||||||| | ||| |||||  | |||
D176-BF2     TGGAAACTCCCTACTGGAATCAATTCAAGTGACTTGGACATGACTGAGTCGTCAGGAGTA
             *********** ** ********    **** ******** **** **  * ****  **

D70A-AA12    ACTATTGCTAGAAAGGGTGACCTTTACTTAAATGCTACTCCTTATCAACCTTCTCGAGAGTAA
              ||| |||||||||| || |||| || ||||| |||||||| || |||| |||||| ||||
D176-BF2     ACTTGTGCTAGAAAGAGTGATTTATACTTGACTGCTACTCCATATCAACTTTCTCAAGAGTGA
             ***  ********** **** * **** *  ***** ****** ******* ***** *
```

PERCENT IDENTITY OF GROUP 30

|          | D176-BF2 | D70A-AA12 |              |
|----------|----------|-----------|--------------|
| D176-BF2 | ***      | 77.0      | SEQ ID NO 94 |
| D70A-AA12|          | ***       | SEQ ID NO 140|

Figure 5K

```
GROUP 1      ExxRxxP       ExxPERF                                                   Gx RxC
D208-AD9     EVLRLYPPGP LLVPHENVED CVVSGYHIPK GTRLFANVMK LQRDPKLWSD PDTFDPERFI ATDIDERGQY YKYIPFGPGR RSC SEQ. ID. No. 2196
  98.8
D120-AH4     EVLRLYPPGP LLVPHENVED CVVSGYHIPK GTRLFANVMK LLRDPKLWPD PDTFDPERFI ATDIDERGQY YKYIPFGSGR RSC SEQ. ID. No. 2197
  97.6
D121-AA8     EVLRLYPPGP LLVPHENVED CVVSGYHIPK GTRLFANVMK LQRDPKLMSD PDTFDPERFI ATDIDERGQY YKYIPFGSGR RSC SEQ. ID. No. 2198
  91.6
D122-AF10    EVLRLYPPGP LLVPHENVED CVVSGYHIPK GTRLFANVMK LQRDPKLMSN PDKFDPERFF ADDIDYRGQH YEFIPFGSGR RSC SEQ. ID. No. 2199
  91.6
D103-AH3     KVLRLYPPGP LLVPHENVKD CVVSGYHIPK GTRLFANVMK LQRDPKLLSN PDKFDPERFI AGDIDFRGHH YEFIPSGSGR RSC SEQ. ID. No. 2200
  98.8
D208-ACB     KVLRLYPPGP LLVPHENVKD CVVSGYHIPK GTRLFANVMK LQRDPKLLSN PDKFDPERFI AGDIDERGH  YEFIPFGSGR RSC SEQ. ID. No. 2201
  98.8
D235-AB1     KVLRLYPPGP LLVPHEYVKD CVVSGYHIPK GTRLFANVMK LQRDPKLLSN PDKFDPERFI AGDIDFRGHH YEFIPFGSGR RSC SEQ. ID. No. 2202

GROUP 2      ExxRxxP       FxPERF                                                    GxRxC
D244-AD4     ETLRLYPPVP FLLPHEAVQD CKVTGYHIPK GTRLYINAWK VHRDPEIWSE PEKFMPNRFL TSKANIDARG QNFEFIPFGS GRRSC SEQ. ID. No. 2203
  100.0
D244-AB6     ETLRLYPPVP FLLPHEAVQD CKVTGYHIPK GTRLYINAWK VHRDPEIWSE PEKFMPNRFL TSKANIDARG QNFEFIPFGS GRRSC SEQ. ID. No. 2204
D285-AA8     ETLRLFPPVP FLLPHEAVQD CKVTGYHIPK GTRLYINAWK VHRDPEIWSE PEKFMPNRFL TSKANIDARG QNFEFIPFGS GRRSC SEQ. ID. No. 2205
  100.0
D285-AB9     ETLRLFPPVP FLLPHEAVQD CKVTGYHIPK GTRLYINAWK VHRDPEIWSE PEKFMPNRFL TSKANIDARG QNFEFIPFGS GRRSC SEQ. ID. No. 2206
  97.6
D268-AE2     ETLRLYPPVP FLLPHEAVQD CKVTGYHIPK GTRLYINAWK VHRDSEIWSE PEKFMPNRFL TSKANIDARG QNFEFIPFGS GRRSC SEQ. ID. No. 2207

GROUP 3      ExxRxxP       FxPERF                                                    GxRx C
D100A-AC3    ETFRMYPAGP LLIVPHESSEE TTVGGYRVPG GTMLIVNLWA IHNDPKLMDE PRKFKPERFE GLEGVRDGYK MMPFGSGRRS C SEQ. ID. No. 2208
  97.6
D100A-BE2    ETFRMYPAGP LLIVPHESSEE TTVGGYRVPG GTMLIVNLWA IHNDPKLMDE PRKFKPERFQ GLDGVRDGYK MMPFGSGRRS C SEQ. ID. No. 2209
```

Figure 6A

```
GROUP 4          ExxRxxP                                                                      GxRxC
D205-BG9         ETMRLYTPIP  LLLPHYSTKD  CIVEGYDVPK  HTMLFVNAWA  IHRDPKVWEE  PDKFKPERFE  ATEGETERFN  YKLVPFGMGR  RAC  SEQ. ID. No. 2210
100.0
D205-BE9         ETMRLYTPIP  LLLPHYSTKD  CIVEGYDVPK  HTMLFVNAWA  IHRDPKVWEE  PDKFKPERFE  ATEGETERFN  YKLVPFGMGR  RAC  SEQ. ID. No. 2211
100.0
D205-AH4         ETMRLYTPIP  LLLPHYSTKD  CIVEGYDVPK  HTMLFVNAWA  IHRDPKVWEE  PDKFKPERFE  ATEGETERFN  YKLVPFGMGR  RAC  SEQ. ID. No. 2212

GROUP 5          ExxRxxP                                                                      GxRxC
D259-AB9         ETMRLHPVAP  MLVPRECRED  IKVAGYDVQK  GTRVLVSVWT  IGRDPTLWDE  PEVFKPERFH  EKSIDVKGHD  YELLPFGAGR  RMC  SEQ. ID. No. 2213
100.0
D257-AE4         ETMRLHPVAP  MLVPRECRED  IKVAGYDVQK  GTRVLVSVWT  IGRDPTLWDE  PEVFKPERFH  EKSIDVKGHD  YELLPFGAGR  RMC  SEQ. ID. No. 2214
98.8
D147-AD3         ETMRLHPVAP  MLVPRECRED  IKVAGYDVQK  GTRVLVSVWT  IGRDPTLWDE  PEVFKPERFH  ERSIDVKGHD  YELLPFGAGR  RMC  SEQ. ID. No. 2215

GROUP 6          MxxRxxP                                                                      GxRxC
D249-AEB         EALRLHPPTP  LMLPHRASAS  VKIGGYDIPK  GSIVHVNVWA  VARDPAVWKN  PLEEFPERFL  EEDVDMKGID  YRLLPFGAGR  RVC  SEQ. ID. No. 2216
98.8
D248-AA6         EALRLHPPTP  LMLPHKASAS  VKIGGYDIPK  GSIVHVNVWA  VARDPAVWKN  PLEEFPERFL  EEDVDMKGHD  YRLLPFGAGR  RVC  SEQ. ID. No. 2217

GROUP 7          ExxRxxP                                                                      GxRxC
D233-AG7         ETLRLHPLGT  MLAPHCAIED  CNVAGYDIQK  GTTFLVNVWT  IGRDPKYWDR  AQEFLPERFL  ENDIDMDGHN  FAFLPFGSGR  RRC  SEQ. ID. No. 2218
98.8
D224-BD11        ETLRLHPLGT  MLAPHCAIED  CNVAGYDIQK  GTTVLVNVWT  IGRDPKYWDR  AQEFLPERFL  ENDIDMDGHN  FAFLPFGSGR  RRC  SEQ. ID. No. 2219
100.0
D224-AF10        ETLRLHPLGT  MLAPHCAIED  CNVAGYDIQK  GTTVLVNVWT  IGRDPKYWDR  AQEFLPERFL  ENDIDMDGHN  FAFLPFGSGR  RRC  SEQ. ID. No. 2220

GROUP 8          ExxRxxP                                                                      GxRxC
D105-AD6         EVLRLYPAGY  VINRMVNKET  KLGNLCLPAG  VQLVLPTMLL  QHDTEIWGDD  AMEFNPERFS  DGISKATKGK  LVFFPFSWGP  RIC  SEQ. ID. No. 2221
100.0
D215-AB5         EVLRLYPAGY  VINRMVNKET  KLGNLCLPAG  VQLVLPTMLL  QHDTEIWGDD  AMEFNPERFS  DGISKATKGK  LVFFPFSWGP  RIC  SEQ. ID. No. 2222
95.2
D135-AE1         EVLRLYPAGY  AINRMVTKET  KLGNLCLPAG  VQLLLPTILL  QHDTEIWGDD  AMEFNPERFS  DGISKATKGK  LVFFPFSWGP  RIC  SEQ. ID. No. 2223
```

```
GROUP 9                ExxRxxP                                              FxPERF                          Gx RxC
D87A-AF3      ESLRLYPPIA TRTRRTNEET KLGELDLPKG ALLFIPTILL HLDKEIWGED ADEFNPERFS EGVAKATKGK MTYPFPGAGP RKC SEQ. ID. No. 2224
 100.0
D210-BD4      ESLRLYPPIA TRTRRTNEET KLGELDLPKG ALLFIPTILL HLDREIWGED ADEFNPERFS EGVAKATKGK MTYPFPGAGP RKC SEQ. ID. No. 2225

GROUP 10               ExxRxxP                                              FxPERF                          Gx RxC
D89-AB1       ETLRMHPPIP LLVPRECMED TKIDGYNIPF KTRVTVNAWA IGRDPESWDD PESFMPERFE NSSIDEFLGNH HQFIPFGAGR RIC SEQ. ID. No. 2226
 100.0
D89-AD2       ETLRMHPPIP LLVPRECMED TKIDGYNIPF KTRVTVNAWA IGRDPESWDD PESFMPERFE NSSIDEFLGNH HQFIPFGAGR RIC SEQ. ID. No. 2227
 100.0
D163-AG12     ETLRMHPPIP LLVPRECMED TKIDGYNIPF KTRVTVNAWA IGRDPESWDD PESFMPERFE NSSIDEFLGNH HQFIPFGAGR RIC SEQ. ID. No. 2228
 98.8
D163-AG11     ETLRMHPPIP LLVPRECMED TKIDGYNIPF KTRVTVNAWA IGRDPQSWDD PESFTPERFE NNSIDEFLGNH HQFIPFGAGR RIC SEQ. ID. No. 2229
 100.0
D163-AF12     ETLRMHPPIP LLVPRECMED TKIDGYNIPF KTRVTVNAWA IGRDPQSWDD PESFTPERFE NNSIDEFLGNH HQFIPFGAGR RIC SEQ. ID. No. 2230

GROUP 11               ExxRxxP                                              FxPERF                          Gx RxC
D267-AF10     ETLRMHPPVP LLGPRECRDQ TEIDGYTVPI KARVMVNAWA IGRDPESWED PESFKPERFE NTSVDLTGNH YQFIPFGSGR RMC SEQ. ID. No. 2231
 100.0
D89-AC2       ETLRMHPPVP LLGPRECRDQ TEIDGYTVPI KARVMVNAWA IGRDPESWED PESFKPERFE NTSVDLTGNH YQFIPFGSGR RMC SEQ. ID. No. 2232
 100.0
D96-AB6       ETLRMHPPVP LLGPRECRDQ TEIDGYTVPI KARVMVNAWA IGRDPESWED PESFKPERFE NTSVDLTGNH YQFIPFGSGR RMC SEQ. ID. No. 2233
 96.4
D207-AA5      ETLRMHPPVP LLGPRECREQ TEIDGYTVPL KARVMVNAWA IGRDPESWED PESFKPERFE NISVDLTGNH YQFIPFGSGR RMC SEQ. ID. No. 2234
 100.0
D207-AB4      ETLRMHPPVP LLGPRECREQ TEIDGYTVPL KARVMVNAWA IGRDPESWED PESFKPERFE NISVDLTGNH YQFIPFGSGR RMC SEQ. ID. No. 2235
 100.0
D207-AC4      ETLRMHPPVP LLGPRECREQ TEIDGYTVPL KARVMVNAWA IGRDPESWED PESFKPERFE NISVDLTGNH YQFIPFGSGR RMC SEQ. ID. No. 2236

GROUP 12               ExxRxxP                                              FxPERF                          Gx RxC
D98-AG1       ETLRLHPPTP LLVPRECREE TEIEGFTIPL KSKVLVNVWA IGRDPENWKN PECFIPERFE NSSIEFTGNH FQLLPFGAGR RIC SEQ. ID. No. 2237
 100.0
D98-AA1       ETLRLHPPTP LLVPRECREE TEIEGFTIPL KSKVLVNVWA IGRDPENWKN PECFIPERFE NSSIEFTGNH FQLLPFGAGR RIC SEQ. ID. No. 2238
```

GROUP 13

|  | ExxRxxP | | | | FxPERF | | Gx RxC | |
|---|---|---|---|---|---|---|---|---|
| D209-AA10 100.0 | ETLRLHPPVP | LLLPRECREE | TNINGYTIPV | KTKVMVNVWA | LGRDPKYWND | AETTMPERFE | QCSKDFVGNN | FEYLPFGGGR RIC SEQ. ID. No. 2239 |
| D209-AA12 100.0 | ETLRLHPPVP | LLLPRECREE | TNINGYTIPV | KTKVMVNVWA | LGRDPKYWND | AETTMPERFE | QCSKDFVGNN | FEYLPFGGGR RIC SEQ. ID. No. 2240 |
| D209-AH10 100.0 | ETLRLHPPVP | LLLPRECREE | TNINGYTIPV | KTKVMVNVWA | LGRDPKYWND | AETTMPERFE | QCSKDFVGNN | FEYLPFGGGR RIC SEQ. ID. No. 2241 |
| D209-AH12 100.0 | ETLRLHPPVP | LLLPRECREE | TNINGYTIPV | KTKVMVNVWA | LGRDPKYWND | AETTMPERFE | QCSKDFVGNN | FEYLPFGGGR RIC SEQ. ID. No. 2242 |
| D90a-BB3 97.6 | ETLRLHPPVP | LLLPRECREE | TNINGYTIPV | KTKVMVNVWA | LGRDPKYWDD | AETTKPERFE | QCSKDFVGNN | FEYLPFGGGR RIC SEQ. ID. No. 2243 |

GRO

| GROUP 17 | EcoRI-P | | ExpERF | | GK RKC | |
|---|---|---|---|---|---|---|
| D284-AH5 86.7 | ESLRLYSPVV | SLIRRPNEDA ILGNVSLPEG VLLSLPVILL HHDEEIWGKD | -KKFNPERFR

FIGURE 7 : Cloning of Cytochrome P450 cDNA Fragments by PCR

| | | | |
|---|---|---|---|
| SEQ ID NO: 2268 | DM3 | FXPERF-for | 5'-TTYIICCIGARMGITTY-3' | SEQ ID NO:2255 |
| SEQ ID NO: 2269 | DM4 | GRRXCP(A/G)-for | 5'-GGIMGIMGIIITGYCCIGS-3' | SEQ ID NO:2256 |
| SEQ ID NO: 2301 | DM12 | FKPERF-for | 5'-TTYAARCCTGAGAGATT-3' | SEQ ID NO:2257 |
| SEQ ID NO: 2302 | DM13 | PERFL-for | 5'-CCAGARAGATTCTTG-3' | SEQ ID NO:2258 |
| SEQ ID NO: 2303 | DM17 | GRRMCP-for | 5'-GGRMGRMGRATGTGYCC-3' | SEQ ID NO:2259 |
| | OLIGO d(T) | | 5'-TTTTTTTTTTTTTTTTTN-3' | SEQ ID NO:2260 |
| | T7 | | 5'-ATTATGCTGAGTGATATCCC-3' | SEQ ID NO:2261 |
| | SP6 | | 5'-ATTTAGGTGACACTATAG-3' | SEQ ID NO:2262 |

I = DeoxyInosines; Y = C,T; M = A,C; R = A,G; S = C,G; N = A,T,C,G

NICOTIANA NUCLEIC ACID MOLECULES AND USES THEREOF

CROSS-REFERENCE TO RELATED APPLICATIONS

This application claims the benefit of U.S. Provisional Application No. 60/665,451, filed Mar. 24, 2005, U.S. Provisional Application No. 60/665,097, filed Mar. 24, 2005, U.S. Provisional Application No. 60/646,764, filed Jan. 25, 2005, U.S. Provisional Application No. 60/607,357, filed Sep. 3, 2004, and U.S. Provisional Application No. 60/566,235, filed Apr. 29, 2004.

The present application is also a continuation-in-part of PCT/US2004/034065, filed Oct. 15, 2004, which claims the benefit of U.S. Application No. 60/566,235, filed Apr. 29, 2004, and which is a continuation-in-part of U.S. application Ser. No. 10/934,944, filed Sept. 3, 2004, which, in turn is a continuation-in-part of U.S. application Ser. No. 10/686,947, filed Oct. 16, 2003 now abandoned. Further, the present application is a continuation-in-part of PCT/US2004/034218, filed Oct. 15, 2004, which claims the benefit of U.S. Application No. 60/566,235, filed Apr. 29, 2004, and which is a continuation-in-part of U.S. application Ser. No. 10/943,507, filed Sept. 17, 2004, which, in turn, is a continuation-in-part of U.S. application Ser. No. 10/686,947, filed Oct. 16, 2003. The present application is also a continuation-in-part of U.S. application Ser. No. 11/110,062, filed Apr. 19, 2005, which, in turn, is a continuation-in-part application of U.S. application Ser. No. 10/934,944, filed Sept. 3, 2004 and is a continuation-in-part of U.S. application Ser. No. 10/943,507, Sept. 17, 2004, each of which is a continuation-in-part of U.S. application Ser. No. 10/686,947, filed Oct. 16, 2003, now abandoned, which, in turn, claims the benefit of U.S. Provisional Application No. 60/503,989, filed Sept. 18, 2003, U.S. Provisional Application No. 60/485,368, filed Jul. 8, 2003, and U.S. Provisional Application No. 60/418,933, filed Oct. 16, 2002. U.S. application Ser. No. 10/686,947, filed Oct. 16, 2003also a continuation-in-part of U.S. application No. 10/387,346, filed Mar. 12, 2003, now abandoned, which, in turn, is a continuation-in-part of U.S. application Ser. No. 10/340,861, filed Jan. 10, 2003, now abandoned, which, in turn, is a continuation-in-part of U.S. application Ser. No. 10/293,252, filed Nov. 13, 2002, now abandoned which claims the benefit of U.S. Provisional Application No. 60/363,684, filed Mar. 12, 2002, U.S. Provisional Application No. 60/347,444, filed Jan. 11, 2002, and U.S. Provisional Application No. 60/337,684, filed on Nov. 13, 2001. All the applications listed herein are incorporated herein by reference.

REFERENCE TO A SEQUENCE LISTING APPENDIX

A compact disc containing the file 07678.141014 replacement sequence listing.txt, 1,806 kB, created on Sept. 23, 2005, has been submitted in duplicate and is hereby incorporated by reference.

The present invention relates to *Nicotiana* nucleic acid sequences such as sequences encoding constitutive, or ethylene or senescence induced polypeptides, in particular cytochrome p450 enzymes (hereinafter referred to as p450 and p450 enzymes), in *Nicotiana* plants and methods for using these nucleic acid sequences to alter plant phenotypes.

BACKGROUND

During tobacco ripening or curing the expression of various genes is altered. Such genes may affect metabolic pathways involved in the formation of numerous secondary metabolites including terpenoids, polyphenols, and alkaloids that affect end-product quality traits. For example, the bioconversion of nicotine to form nornicotine during plant senescence and in the post-harvest or leaf curing phase occurs in many *Nicotiana* species. Nicotine is the predominant source of nornicotine. The nornicotine alkaloid, is a substrate for microbe-mediated nitrosation to form the tobacco specific nitrosamine (TSNA) N'-nitrosonornicotine (NNN) during leaf curing or subsequent leaf storage and processing.

Genes expressed during tobacco ripening or curing may be constitutively expressed, ethylene-induced or senescence-related genes, for instance, genes encoding a cytochrome p450. Cytochrome p450s, for example, catalyze enzymatic reactions for a diverse range of chemically dissimilar substrates that include the oxidative, peroxidative, and reductive metabolism of endogenous and xenobiotic substrates. In plants, p450s participate in biochemical pathways that include the synthesis of plant products such as phenylpropanoids, alkaloids, terpenoids, lipids, cyanogenic glycosides, and glucosinolates studied (Chappell, Annu. Rev. Plant Physiol. Plant Mol. Biol. 46:521-547, 1995). Cytochrome p450s, also known as p450 heme-thiolate proteins, usually act as terminal oxidases in multi-component electron transfer chains, called p450-containing monooxygenase systems. Specific reactions catalyzed by these enzyme systems include demethylation, hydroxylation, epoxidation, N-oxidation, sulfooxidation, N—, S—, and O-dealkylations, desulfation, deamination, and reduction of azo, nitro, and N-oxide groups.

The diverse role of *Nicotiana* plant p450 enzymes has been implicated in effecting a variety of plant metabolites such as phenylpropanoids, alkaloids, terpenoids, lipids, cyanogenic glycosides, glucosinolates, and a host of other chemical entities. Some p450 enzymes can impact the composition of plant metabolites. For example, it has been long desired to improve the flavor and aroma of certain plants by altering a plant's profile of selected fatty acids through breeding; however very little is known about mechanisms involved in controlling the levels of these leaf constituents. The down regulation or up regulation of p450 enzymes associated with the modification of fatty acids may facilitate accumulation of desired fatty acids that provide more preferred leaf phenotypic qualities.

The function of p450 enzymes and their broadening roles in plant constituents is still being discovered. For instance, a special class of p450 enzymes was found to catalyze the breakdown of fatty acid into volatile C6- and C9-aldehydes and β-alcohols that are major contributors of "fresh green" odor of fruits and vegetables. The level of other novel targeted p450s may be altered to enhance the qualities of leaf constituents by modifying lipid composition and related breakdown metabolites in *Nicotiana* leaf. Several of these constituents in leaf are affected by senescence that stimulates the maturation of leaf quality properties. Still other reports have shown that p450s enzymes are play a functional role in altering fatty acids that are involved in plant-pathogen interactions and disease resistance.

The large multiplicity of p450 enzyme forms, their differing structure and function have made their research on *Nicotiana* p450 enzymes very difficult before the present invention. In addition, cloning of p450 enzymes has been hampered at least in part because these membrane-localized proteins are typically present in low abundance and often unstable during purification. Hence, a need exists for the identification of p450 enzymes in plants and the nucleic acid sequences associated with those p450 enzymes. In particular, only a few cytochrome p450 proteins have been reported in *Nicotiana*. The inventions described herein entail the discovery of cytochrome 450s and cytochrome p450 fragments that correspond to several groups of p450 species based on their sequence identity.

In addition to the p450 sequences, the present invention encompasses the discovery of other constitutive and ethylene or senescence induced sequences that address the need for regulating metabolic pathways involved in the formation of secondary metabolites that affect the quality of a tobacco product. These sequences are also useful in the development of plant germplasms that have desirable traits for use in breeding programs to develop more desirable germplasms, and especially non-GMO (genetically modified organism) type germplasms.

SUMMARY OF THE INVENTION

The present inventors have identified and characterized constitutive, and ethylene and senescene induced sequences, including a genomic clone of nicotine demethylase, from tobacco. Also described herein is the use of these sequences in breeding methods and in methods to create a plant (e.g., a transgenic plant) having desirable traits, such as altered levels of nornicotine or N'-nitrosonornicotine ("NNN") or both relative to a control plant.

In one aspect, the invention features a breeding method for producing a tobacco plant having decreased expression of a nicotine demethylase gene, the method including the steps of: (a) providing a first tobacco plant having variant nicotine demethylase gene expression; (b) providing a second tobacco plant that contains at least one phenotypic trait; (c) crossing the first tobacco plant with the second tobacco plant to produce an F1 progeny plant; (d) collecting seed of the F1 progeny for the variant nicotine demethylase gene expression; and (e) germinating the seed to produce a tobacco plant having decreased expression of the nicotine demethylase gene.

In one embodiment, a tobacco plant is identified as variant for nicotine demethylase gene expression (e.g., at the transcriptional, post transcriptional, or translational levels or at the level of enzymatic activity) using the sequences described herein and standard methods known in the art.

In another embodiment of this breeding method, the first tobacco plant includes an endogenous nicotine demethylase gene having a mutation (e.g., a deletion, substitution, point mutation, translocation, inversion, duplication, or an insertion). In another embodiment, the first tobacco plant includes a nicotine demethylase gene having a null mutation, includes a recombinant gene that silences an endogenous nicotine demethylase gene, or includes a nicotine demethylase having reduced or altered enzymatic activity. In yet another embodiment, the nicotine demethylase gene of the first tobacco plant is absent. In still another embodiment, the first tobacco plant is a transgenic plant.

Exemplary first tobacco plants useful in the breeding methods disclosed herein include *Nicotiana africana, Nicotiana amplexicaulis, Nicotiana arentsii, Nicotiana benthamiana, Nicotiana bigelovii, Nicotiana corymbosa, Nicotiana debneyi, Nicotiana excelsior, Nicotiana exigua, Nicotiana glutinosa, Nicotiana goodspeedii, Nicotiana gossei, Nicotiana hesperis, Nicotiana ingulba, Nicotiana knightiana, Nicotiana maritima, Nicotiana megalosiphon, Nicotiana miersii, Nicotiana nesophila, Nicotiana noctiflora, Nicotiana nudicaulis, Nicotiana otophora, Nicotiana palmeri, Nicotiana paniculata, Nicotiana petunioides, Nicotiana plumbaginifolia, Nicotiana repanda, Nicotiana rosulata, Nicotiana rotundifolia, Nicotiana rustica, Nicotiana setchelli, Nicotiana stocktonii, Nicotiana eastii, Nicotiana suaveolens* or *Nicotiana trigonophylla*. Desirably the first tobacco plant is *Nicotiana amplexicaulis, Nicotiana benthamiana, Nicotiana bigelovii, Nicotiana debneyi, Nicotiana excelsior, Nicotiana glutinosa, Nicotiana goodspeedii, Nicotiana gossei, Nicotiana hesperis, Nicotiana knightiana, Nicotiana maritima, Nicotiana megalosiphon, Nicotiana nudicaulis, Nicotiana paniculata, Nicotiana plumbaginifolia, Nicotiana repanda, Nicotiana rustica, Nicotiana suaveolens* or *Nicotiana trigonophylla*. Other first tobacco plants include varieties of *Nicotiana tabacum* (or *Nicotiana rustica*) or transgenic lines associated therewith that have been engineered to have decreased levels of nicotine demethylase. Other exemplary first tobacco plants include an Oriental, a dark tobacco, flue or air-cured tobacco, Virginia, or a Burley tobacco plant.

In another embodiment of the above-described breeding method, the second tobacco plant is *Nicotiana tabacum*. Exemplary varieties of *Nicotiana tabacum* include commercial varieties such as BU 64, CC 101, CC 200, CC 27, CC 301, CC 400, CC 500, CC 600, CC 700, CC 800, CC 900, Coker 176, Coker 319, Coker 371 Gold, Coker 48, CU 263, DF911, Galpao tobacco, GL 26H, GL 350, GL 737, GL 939, GL 973, HB 04P, K 149, K 326, K 346, K 358, K 394, K 399, K 730, KT 200, KY 10, KY 14, KY 160, KY 17, KY 171, KY 907, KY 160, Little Crittenden, McNair 373, McNair 944, msKY 14×L8, Narrow Leaf Madole, NC 100, NC 102, NC 2000, NC 291, NC 297, NC 299, NC 3, NC 4, NC 5, NC 6, NC 606, NC 71, NC 72, NC 810, NC BH 129, OXFORD 207, 'Perique' tobacco, PVH03, PVH09, PVH19, PVH50, PVH51, R 610, R 630, R 7-11, R 7-12, RG 17, RG 81, RG H4, RG H51, RGH 4, RGH 51, RS 1410, SP 168, SP 172, SP 179, SP 210, SP 220, SP G-28, SP G-70, SP H20, SP NF3, TN 86, TN 90, TN 97, TN D94, TN D950, TR (Tom Rosson) Madole, VA 309, VA 309, or VA 359.

In still other embodiments, the phenotypic trait of the second tobacco plant includes disease resistance; high yield; high grade index; curability; curing quality; mechanical harvestability; holding ability; leaf quality; height, plant maturation (e.g., early maturing, early to medium maturing, medium maturing, medium to late maturing, or late maturing); stalk size (e.g., a small, medium, or a large stalk); or leaf number per plant (e.g., a small (e.g., 5-10 leaves), medium (e.g., 11-15 leaves), or large (e.g., 16-21) number of leaves). In still other embodiments, the method further includes self-pollinating or pollinating a male sterile pollen acceptor, a pollen donor capable of being used in production of a hybrid or a male sterile hybrid with the plant of step (b) or backcrossing or self-pollinating plants produced from germinated seed of step (e).

In another aspect, the invention features a method of breeding a nicotine demethylase deficiency trait into a tobacco plant, the method including the steps of: a) crossing a first tobacco plant having variant nicotine demethylase gene expression with a second tobacco plant; b) producing progeny tobacco plants of the cross; c) extracting a DNA sample from progeny tobacco plants; d) contacting the DNA sample with a marker nucleic acid molecule that hybridizes to a nicotine demethylase gene or fragment thereof; and e) performing a marker assisted breeding method for the variant nicotine demethylase gene expression trait. For example, plants are identified as having variant gene expression of a nicotine demethylase and, if desired, are further tested for nicotine demethylase gene expression or tested using standard alkaloid profiling or immunoblotting analysis. Typically such a marker assisted breeding method includes utilizing an amplified fragment length polymorphism, restriction fragment length polymorphism, random amplified polymorphism display, single nucleotide polymorphism, a microsatellite marker, or a targeted induced local lesion in a tobacco genome.

In yet another aspect, the invention features a method of producing tobacco seed, including crossing any one of the tobacco plants selected from the group consisting of *Nicotiana africana, Nicotiana amplexicaulis, Nicotiana arentsii, Nicotiana benthamiana, Nicotiana bigelovii, Nicotiana corymbosa, Nicotiana debneyi, Nicotiana excelsior, Nicotiana exigua, Nicotiana glutinosa, Nicotiana goodspeedii, Nicotiana gossei, Nicotiana hesperis, Nicotiana ingulba, Nicotiana knightiana, Nicotiana maritima, Nicotiana megalosiphon, Nicotiana miersii, Nicotiana nesophila, Nicotiana noctiflora, Nicotiana nudicaulis, Nicotiana otophora, Nicotiana palmeri, Nicotiana paniculata, Nicotiana petunioides, Nicotiana plumbaginifolia, Nicotiana repanda, Nicotiana rosulata, Nicotiana rotundifolia, Nicotiana rustica, Nicotiana setchelli, Nicotiana stocktonii, Nicotiana eastii, Nicotiana suaveolens*, and *Nicotiana trigonophylla* with itself. In one embodiment, the method further includes a method of preparing hybrid tobacco seed, including crossing a tobacco plant having variant nicotine demethylase gene expression to a second, distinct tobacco plant. In still another embodiment of this method, the crossing includes the steps of: (a) planting a seed of the cross resulting from the tobacco plant having variant nicotine demethylase gene expression and a second, distinct tobacco plant; (b) growing tobacco plants from the seed until the plants bear flowers; (c) pollinating a flower of the tobacco plant having variant nicotine demethylase gene expression with pollen from the second tobacco plant or pollinating a flower of the second tobacco plant with pollen from the flower of the tobacco plant having variant nicotine demethylase gene expression; and (d) harvesting seed resulting from the pollinating.

In still another aspect, the invention features a method for developing a tobacco plant in a tobacco breeding program including: (a) providing a tobacco plant, or its components, having variant nicotine demethylase gene expression; and (b) employing the plant or plant components as a source of breeding material using tobacco plant breeding techniques. Exemplary plant breeding techniques useful for practicing this method include bulk selection, backcrossing, self-pollination, introgression, pedigree selection, pureline selection, haploid/doubled haploid breeding, or single seed descent.

In another aspect, the invention features a breeding method for producing a tobacco plant having a modified attribute, the method including the steps of: (a) providing a first tobacco plant having a modified attribute including variant gene expression of a nucleic acid molecule selected from the group consisting of the nucleic acid sequences shown in FIGS. 2 to 7 and SEQ ID NOS: 446 to 2193; (b) providing a second tobacco plant that contains at least one phenotypic trait; (c) crossing the first tobacco plant with the second tobacco plant to produce an F1 progeny plant; (d) collecting seed of the F1 progeny for the modified attribute; and (e) germinating the seed to produce a tobacco plant having the modified attribute. In one embodiment, the first tobacco plant includes an endogenous nucleic acid molecule selected from the group consisting of the nucleic acid sequences shown in FIGS. 2 to 5 and SEQ ID NOS: 446 to 2193, wherein the nucleic acid includes a mutation. Exemplary mutations include deletion, substitution, point mutation, translocation, inversion, duplication, or an insertion.

In still another embodiment, the first tobacco plant of the above-described method includes an endogenous nucleic acid molecule selected from the group consisting of the nucleic acid sequences shown in FIGS. 2 to 7 and SEQ ID NOS: 446 to 2193, wherein the nucleic acid includes a null mutation. In still yet another embodiment, the first tobacco plant includes a recombinant gene that silences expression of endogenous nucleic acid molecule an endogenous nucleic acid molecule selected from the group consisting of the nucleic acid sequences shown in FIGS. 2 to 7 and SEQ ID NOS: 446 to 2193.

The first tobacco plant includes, if desired, an endogenous nucleic acid molecule selected from the group consisting of the nucleic acid sequences shown in FIGS. 2 to 7 and SEQ ID NOS: 446 to 2193; wherein the nucleic acid molecule encodes a polypeptide having reduced or altered enzymatic activity. In still other embodiments, the first tobacco plant is a transgenic plant.

Exemplary first tobacco plants useful in the breeding methods disclosed herein include *Nicotiana africana, Nicotiana amplexicaulis, Nicotiana arentsii, Nicotiana benthamiana, Nicotiana bigelovii, Nicotiana corymbosa, Nicotiana debneyi, Nicotiana excelsior, Nicotiana exigua, Nicotiana glutinosa, Nicotiana goodspeedii, Nicotiana gossei, Nicotiana hesperis, Nicotiana ingulba, Nicotiana knightiana, Nicotiana maritima, Nicotiana megalosiphon, Nicotiana miersii, Nicotiana nesophila, Nicotiana noctiflora, Nicotiana nudicaulis, Nicotiana otophora, Nicotiana palmeri, Nicotiana paniculata, Nicotiana petunioides, Nicotiana plumbaginifolia, Nicotiana repanda, Nicotiana rosulata, Nicotiana rotundifolia, Nicotiana rustica, Nicotiana setchelli, Nicotiana stocktonii, Nicotiana eastii, Nicotiana suaveolens* or *Nicotiana trigonophylla*. Other first tobacco plants include varieties of *Nicotiana tabacum* or *Nicotiana rustica*. Still other first tobacco plant is an Oriental, a dark tobacco, flue or air-cured tobacco, Virginia, or a Burley tobacco plant.

In another embodiment of the above-described breeding method, the second tobacco plant is *Nicotiana tabacum*. Exemplary varieties of *Nicotiana tabacum* include commercial varieties such as BU 64, CC 101, CC 200, CC 27, CC 301, CC 400, CC 500, CC 600, CC 700, CC 800, CC 900, Coker 176, Coker 319, Coker 371 Gold, Coker 48, CU 263, DF911, Galpao tobacco, GL 26H, GL 350, GL 737, GL 939, GL 973, HB 04P, K 149, K 326, K 346, K 358, K 394, K 399, K 730, KT 200, KY 10, KY 14, KY 160, KY 17, KY 171, KY 907, KY 160, Little Crittenden, McNair 373, McNair 944, msKY 14×L8, Narrow Leaf Madole, NC 100, NC 102, NC 2000, NC 291, NC 297, NC 299, NC 3, NC 4, NC 5, NC 6, NC 606, NC 71, NC 72, NC 810, NC BH 129, OXFORD 207, 'Perique' tobacco, PVH03, PVH09, PVH19, PVH50, PVH51, R 610, R 630, R 7-11, R 7-12, RG 17, RG 81, RG H4, RG H51, RGH 4, RGH 51, RS 1410, SP 168, SP 172, SP 179, SP 210, SP 220, SP G-28, SP G-70, SP H20, SP NF3, TN 86, TN 90, TN 97, TN D94, TN D950, TR (Tom Rosson) Madole, VA 309, VA 309, or VA 359.

In still other embodiments, the phenotypic trait of the second tobacco plant includes disease resistance; high yield; high grade index; curability; curing quality; mechanical harvestability; holding ability; leaf quality; height, plant maturation (e.g., early maturing, early to medium maturing, medium maturing, medium to late maturing, or late maturing); stalk size (e.g., a small, medium, or a large stalk); or leaf number per plant (e.g., a small (e.g., 5-10 leaves), medium (e.g., 11-15 leaves), or large (e.g., 16-21) number of leaves).

In still further embodiments, the method includes pollinating a male sterile or a male sterile hybrid with the plant of step (b) or backcrossing or pollinating plants produced from germinated seed of step (e). In another aspect, the invention features a method of breeding an attribute into a tobacco plant, the method including the steps of: a) crossing a first tobacco plant having a modified attribute including variant gene expression of a nucleic acid molecule selected from the group consisting of the nucleic acid sequences shown in FIGS. 2 to 7 and SEQ ID NOS: 446 to 2193 with a second tobacco plant; b) producing progeny tobacco plants of the cross; c) extracting a DNA sample from progeny tobacco plants; d) contacting the DNA sample with a marker nucleic acid molecule that hybridizes to a nucleic acid molecule selected from the group consisting of the nucleic acid sequences shown in FIGS. 2 to 7 and SEQ ID NOS: 446 to 2193 or a fragment thereof; and e) performing a marker assisted breeding method for the modified attribute. Typically such a marker assisted breeding method includes utilizing an amplified fragment length polymorphism, restriction fragment length polymorphism, random amplified polymorphism display, single nucleotide polymorphism, a microsatellite marker, or a targeted induced local lesion in a tobacco genome.

In yet another aspect, the invention features a method of producing tobacco seed, including crossing any one of the tobacco plants selected from the group consisting of *Nicotiana africana, Nicotiana amplexicaulis, Nicotiana arentsii, Nicotiana benthamiana, Nicotiana bigelovii, Nicotiana corymbosa, Nicotiana debneyi, Nicotiana excelsior, Nicotiana exigua, Nicotiana glutinosa, Nicotiana goodspeedii, Nicotiana gossei, Nicotiana hesperis, Nicotiana ingulba, Nicotiana knightiana, Nicotiana maritima, Nicotiana megalosiphon, Nicotiana miersii, Nicotiana nesophila, Nicotiana noctiflora, Nicotiana nudicaulis, Nicotiana otophora, Nicotiana palmeri, Nicotiana paniculata, Nicotiana petunioides, Nicotiana plumbaginifolia, Nicotiana repanda, Nicotiana rosulata, Nicotiana rotundifolia, Nicotiana rustica, Nicotiana setchelli, Nicotiana stocktonii, Nicotiana eastii, Nicotiana suaveolens* and *Nicotiana trigonophylla* with a tobacco plant having a modified attribute including variant gene expression of a nucleic acid molecule selected from the group consisting of the nucleic acid sequences shown in FIGS. 2 to 7 and SEQ ID NOS: 446 to 2193 to a second, distinct tobacco plant.

In still another embodiment, crossing includes the steps of: (a) planting a seed of the cross resulting from the tobacco plant having the modified attribute and a second, distinct tobacco plant; (b) growing tobacco plants from the seed until the plants bear flowers; (c) pollinating a flower of the tobacco plant having a modified attribute with pollen from the second tobacco plant or pollinating a flower of the second tobacco plant with pollen from the plant of the tobacco plant having the modified attribute; and (d) harvesting seed resulting from the pollinating.

In still another aspect, the invention features a method for developing a tobacco plant in a tobacco breeding program including: (a) providing a tobacco plant, or its components, having a modified attribute including variant gene expression of a nucleic acid molecule selected from the group consisting of the nucleic acid sequences shown in FIGS. 2 to 7 and SEQ ID NOS: 446 to 2193; and (b) employing the plant or plant components as a source of breeding material using tobacco plant breeding techniques. Exemplary plant breeding techniques include bulk selection, backcrossing, self-pollination, introgression, pedigree selection, pureline selection, haploid/doubled haploid breeding, or single seed descent.

In related aspects the invention features a tobacco plant or components thereof, produced according to any one of the aforementioned breeding methods. In still a further related aspect, the invention features a tissue culture of regenerable tobacco cells obtained from any one of the plants bred or produced according to the methods described herein. Such tissue cultures regenerate tobacco plants capable of expressing all the physiological and morphological characteristics of the tobacco plant having variant nicotine demethylase gene expression or a modified attribute. Exemplary regenerable cells are embryos, meristematic cells, seeds, pollen, leaves, roots, root tips, or flowers or are protoplasts or callus derived therefrom.

In still related aspects, the invention features a method of producing a tobacco product involving: (a) providing a tobacco plant produced according to any one of the aforementioned breeding methods; and (b) preparing a tobacco product from the tobacco plant. Exemplary tobacco products include leaves or stems or both; a smokeless tobacco product; a moist or dry snuff; a chewing tobaccos; cigarette products; cigar products; cigarillos; pipe tobaccos; or bidis.

An aspect of the invention features an isolated genetic marker including a nucleic acid sequence that is substantially identical, desirably at least 70% identical, to a nucleic acid sequence shown in FIGS. 2 to 7 and SEQ ID NOS: 446 to 2193. In a desirable embodiment of this aspect of the invention, the nucleic acid sequence includes a sequence that hybridizes under stringent conditions to the complement of a nucleic acid sequence shown in FIGS. 2 to 7 and SEQ ID NOS: 446 to 2193. In other desirable embodiments, the nucleic acid sequence is constitutive, or ethylene or senescence induced. In addition, the nucleic acid sequence desirably encodes a polypeptide that is substantially identical to an amino acid sequence shown in FIGS. 2 to 7 and SEQ ID NOS: 446 to 548.

In other desirable embodiments of the invention, the nucleic acid sequence is operably linked to a heterologous gene or the nucleic acid sequence is operably linked to an inducible, constitutive, pathogen- or wound-induced, environmentally- or developmentally-regulated, or cell- or tissue-specific promoter.

In another aspect, the invention features an expression vector containing a nucleic acid sequence shown in FIGS. 2 to 7 and SEQ ID NOS: 446 to 2193, where the vector is capable of directing expression of the polypeptide encoded by the nucleic acid sequence.

Further aspects of the invention features a substantially pure polypeptide containing the amino acid sequence of a polypeptide shown in FIGS. 2 to 7 and SEQ ID NOS: 446 to 548, as well as antibodies that specifically recognize the polypeptide.

An additional aspect of the invention features a plant or plant component containing an isolated nucleic acid sequence shown in FIGS. 2 to 7 and SEQ ID NOS: 446 to 2193, where the nucleic acid sequence is expressed in the plant or the plant component, or a nucleic acid sequence that encodes a polypeptide that is substantially identical to an amino acid sequence shown in FIGS. 2 to 7 and SEQ ID NOS: 446 to 548, where the nucleic acid sequence is expressed in the plant or the plant component. Desirably, the plant or plant component is a species of *Nicotiana*, for example, a *Nicotiana* species shown in Table 8. In other desirable embodiments, the plant component is a leaf, e.g., a cured tobacco leaf, a stem, or a seed. A desirable embodiment features a plant from the germinated seed.

In a further aspect, the invention features a tobacco product containing a plant or plant component containing an isolated nucleic acid sequence shown in FIGS. 2 to 7 and SEQ ID NOS: 446 to 2193, where the nucleic acid sequence is expressed in the plant or the plant component. Desirably, the expression of an endogenous gene in the cured tobacco plant or plant component is silenced. In other desirable embodiments, the tobacco product is a smokeless tobacco product, moist or dry snuff, a chewing tobaccos, cigarette products, cigar products, cigarillos, pipe tobaccos, or bidis.

In particular, the tobacco product of this aspect of the invention may contain dark tobacco, milled tobacco, or include a flavoring component.

An additional aspect of the invention features a method for reducing the expression or enzymatic activity of a constitutive, or an ethylene induced or senescence induced tobacco polypeptide in a plant cell. This method involves reducing the level or enzymatic activity of an endogenous constitutive, or ethylene or senescence induced tobacco polypeptide in the plant cell. In a desirable embodiment, the tobacco polypeptide is a p450. In other desirable embodiments, the plant cell is from a species of *Nicotiana*, e.g., one of the *Nicotiana* species shown in Table 8.

In further desirable embodiments, reducing the level of the endogenous constitutive, or ethylene or senescence induced tobacco polypeptide involves expressing a transgene encoding an antisense nucleic acid molecule of a nucleic acid sequence shown in FIGS. 2 to 7 and SEQ ID NOS: 446 to 2193 a nucleic acid sequence that encodes a polypeptide containing an amino acid sequence shown in FIGS. 2 to 7 and SEQ ID NOS: 446 to 548 in the plant cell. In another desirable embodiment, the transgene encodes a double-stranded RNA molecule of a constitutive, or an ethylene or senescence induced tobacco nucleic acid or amino acid sequence in the plant cell. In other desirable embodiments, the transgene is expressed, for example, in a tissue-specific, cell-specific, or organ-specific manner. In addition, reducing the level of the endogenous constitutive, or ethylene or senescence induced tobacco polypeptide desirably involves co-suppression of the constitutive, or ethylene or senescence induced tobacco polypeptide in the plant cell. In another desirable embodiment, reducing the level of the endogenous constitutive, or ethylene or senescence induced tobacco polypeptide involves expressing a dominant negative gene product in the plant cell. Desirably, the endogenous constitutive, or ethylene or senescence induced tobacco polypeptide includes a mutation in a gene that encodes an amino acid sequence shown in FIGS. 2 to 7 and SEQ ID NOS: 446 to 548. In further desirable embodiments, reduced expression occurs at the transcriptional level, at the translational level, or at the post-translational level.

An additional aspect the invention features a method for increasing the expression or enzymatic activity of a constitutive, or an ethylene or senescence induced tobacco polypeptide in a plant cell. This method involves increasing the level or enzymatic activity of an endogenous constitutive, or ethylene or senescence induced tobacco polypeptide in the plant cell. In a desirable embodiment of this aspect of the invention, the plant cell is from a species of *Nicotiana*, for example, a Nicotiana species shown in Table 8. In another desirable embodiment, increasing the level of the constitutive, or ethylene or senescence induced tobacco polypeptide involves expressing a transgene including a nucleic acid sequence shown in FIGS. 2 to 7 and SEQ ID NOS: 446 to 2193 or a nucleic acid sequence that encodes a polypeptide containing an amino acid sequence shown in FIGS. 2 to 7 and SEQ ID NOS: 446 to 548 in the plant cell. Desirably, increased expression occurs at the transcriptional level, at the translational level, or at the post-translational level.

A further aspect of the invention features a method of producing a constitutive, or an ethylene or senescence induced tobacco polypeptide. This method involves the steps of: (a) providing a cell transformed with an isolated nucleic acid molecule containing a nucleic acid sequence shown in FIGS. 2 to 7 and SEQ ID NOS: 446 to 2193; (b) culturing the transformed cell under conditions for expressing the isolated nucleic acid molecule; and (c) recovering the constitutive, or ethylene or senescence induced tobacco polypeptide. Desirably, the constitutive, or ethylene or senescence induced tobacco polypeptide is a p450. In another desirable embodiment, the invention features a recombinant constitutive, or ethylene or senescence induced tobacco polypeptide produced according to the method of this aspect of the invention.

In another aspect, the invention features a method of isolating a constitutive, or an ethylene or senescence induced tobacco polypeptide or fragment thereof. This method involves the steps of: (a) contacting a nucleic acid sequence shown in FIGS. 2 to 7 and SEQ ID NOS: 446 to 2193 or a portion thereof with a nucleic acid preparation from a plant cell under hybridization conditions providing detection of nucleic acid sequences having at least 70% or greater sequence identity to a nucleic acid sequence shown in FIGS. 2 to 7 and SEQ ID NOS: 446 to 2193; and (b) isolating the hybridizing nucleic acid sequences. Desirably, the constitutive, or ethylene or senescence induced tobacco polypeptide is a p450.

A further aspect of the invention features an isolated nucleic acid molecule, for example, a DNA sequence, containing a nucleotide sequence encoding a nicotine demethylase. In desirable embodiments, the nucleotide sequence of the first aspect is substantially identical to a nucleotide sequence encoding a tobacco nicotine demethylase, such as a tobacco nicotine demethylase containing a nucleotide sequence that is at least 70% identical to the nucleotide sequence of SEQ ID NO:4 or SEQ ID NO:5, or that contains nucleotides 2010-2949 and/or 3947-4562 of SEQ ID NO:4, or that contains the sequence of SEQ ID NO:4 or SEQ ID NO:5. The isolated nucleic acid molecule of the first aspect of the invention, for example, is operably linked to a promoter functional in a plant cell and desirably is contained in an expression vector. In other desirable embodiments, the expression vector is contained in a cell, e.g., a plant cell. Desirably, the plant cell, such as a tobacco plant cell, is included in a plant. In another desirable embodiment, the invention features a seed, e.g., a tobacco seed, from a plant containing the expression vector, where the seed includes an isolated nucleic acid molecule that hybridizes under stringent conditions to the sequence of SEQ ID NO:4 operably linked to a heterologous promoter sequence. Furthermore, the invention features a plant derived from a germinated seed containing the expression vector, a leaf, either green or cured, from the plant, and an article of manufacture made from the leaf.

In another desirable embodiment, the nucleotide sequence contains a sequence that hybridizes under stringent conditions to the complement of the nucleotide sequence of SEQ ID NO:4 and/or SEQ ID NO:5, or to a fragment of SEQ ID NO:4 or SEQ ID NO:5. Desirably, the nucleotide sequence encodes a nicotine demethylase that is substantially identical to the amino acid sequence of SEQ ID NO:3. In a further desirable embodiment of the first aspect of the invention, the nicotine demethylase has at least 70% amino acid sequence identity to the nicotine demethylase amino acid sequence of SEQ ID NO:3 or to a fragment of a nicotine demethylase having altered (e.g., reduced) enzymatic activity as compared to the full-length polypeptide. Desirably, the nicotine demethylase includes the amino acid sequence of SEQ ID NO:3.

In another aspect, the invention features an isolated nucleic acid molecule containing a promoter that hybridizes under stringent conditions to the sequence of SEQ ID NO:8, or a fragment thereof that drives transcription. Desirably, the promoter (i) is induced following treatment with ethylene or during senescence; and (ii) includes (a) base pairs 1-2009 of SEQ ID NO:4, or (b) at least 200 consecutive base pairs identical to 200 consecutive base pairs of the sequence defined by base pairs 1-2009 of SEQ ID NO:4, or (c) a 20 base pair nucleotide portion identical in sequence to a 20 consecutive base pair portion of the sequence set forth in base pairs 1-2009 of SEQ ID NO:4.

A further aspect of the invention features an isolated nucleic acid promoter containing a nucleotide sequence having 50% or more sequence identity with the sequence of SEQ ID NO:8. Desirably, this isolated nucleic acid promoter is induced following treatment with ethylene or during senescence and, for example, includes the sequence of SEQ ID NO:8. Alternatively, the promoter may include a fragment obtainable from SEQ ID NO:8, where the fragment drives transcription of a heterologous gene or reduces or alters nicotine demethylase enzymatic activity (for example, silences gene expression). In a desirable embodiment the promoter sequence is operably linked to a heterologous nucleic acid sequence, and may, for example be contained in an expression vector. In other desirable embodiments the expression vector is contained in a cell, e.g., a plant cell. Desirably, the plant cell, such as a tobacco plant cell, is included in a plant. In another desirable embodiment, the invention features a seed, e.g., a tobacco seed, from a plant containing the expression vector, where the seed includes an isolated nucleic acid molecule that hybridizes under stringent conditions to the sequence of SEQ ID NO:8 operably linked to a heterologous nucleic acid sequence. Furthermore, the invention features a plant derived from a germinated seed containing the promoter of this aspect of the invention, a leaf, either green or cured, from the plant, and an article of manufacture made from the leaf.

Another aspect of the invention features a method of expressing a heterologous gene in a plant. This method involves (i) introducing into a plant cell a vector containing a promoter sequence having 50% or more sequence identity with the sequence of SEQ ID NO:8 operably linked to a heterologous nucleic acid sequence; and (ii) regenerating a plant from the cell. In addition, this method may involve sexually transmitting the vector to progeny and, further, may include the step of collecting the seed produced by the progeny.

In yet another aspect, the invention features a method of reducing expression of nicotine demethylase in a tobacco plant. This method includes the steps of (i) introducing into the tobacco plant a vector containing the sequence of SEQ ID NO:8 or a fragment obtainable from SEQ ID NO:8 operably linked to a heterologous nucleic acid sequence and (ii) expressing the vector in the tobacco plant. In a desirable embodiment of this method, expression of the nicotine demethylase is silenced. In other desirable embodiment, the vector expresses RNA, such as antisense RNA or an RNA molecule capable of inducing RNA interference (RNAi).

In a further desirable aspect, the invention features an isolated nucleic acid molecule containing an intron that hybridizes under stringent conditions to the sequence of SEQ ID NO:7, or a fragment thereof that reduces or alters nicotine demethylase enzymatic activity (for example, silences gene expression) or can serve as a molecular marker to identify nicotine demethylase nucleic acid sequences. In a desirable embodiment, the intron includes (a) base pairs 2950-3946 of SEQ ID NO:4, or (b) at least 200 consecutive base pairs identical to 200 consecutive base pairs of the sequence defined by base pairs 2950-3946 of SEQ ID NO:4, or (c) a 20 base pair nucleotide portion identical in sequence to a 20 consecutive base pair portion of the sequence set forth in base pairs 2950-3946 of SEQ ID NO:4.

Another desirable aspect of the invention features an isolated nucleic acid intron including a nucleotide sequence having 50% or more sequence identity with the sequence of SEQ ID NO:7, or a fragment thereof that reduces or alters nicotine demethylase enzymatic activity (for example, silences gene expression) or can serve as a molecular marker to identify nicotine demethylase nucleic acid sequences. Silencing gene expression may, for example, involve homologous recombination (e.g., using the sequence of SEQ ID NO:188, or a fragment thereof) or a mutation that results in a gene product that does not have nicotine demethylase activity. In particular, the intron may include the sequence of SEQ ID NO:7 or a fragment obtainable from SEQ ID NO:7. Desirably, an isolated nucleic acid molecule including an intron is operably linked to a heterologous nucleic acid sequence and this sequence desirably is included in an expression vector. In another embodiment, the expression vector is contained in a cell, such as a plant cell. In particular, the cell may be a tobacco cell. A plant, e.g., a tobacco plant, including a plant cell plant containing the sequence of SEQ ID NO:7 or a fragment obtainable from SEQ ID NO:7 operably linked to a heterologous nucleic acid sequence in an expression vector is another desirable embodiment of the present invention. Further, a seed, for example, a tobacco seed, from a plant, where the seed contains an intron that hybridizes under stringent conditions to SEQ ID NO:7 operably linked to a heterologous nucleic acid sequence is also desirable. Furthermore, the invention features a plant derived from the germinated seed containing the intron of this aspect of the invention, a leaf, either green or cured, from the plant, and an article of manufacture made from the green or cured leaf.

A further aspect of the invention features a method of expressing an intron in a plant. This method involves (i) introducing into a plant cell an expression vector containing the sequence of SEQ ID NO:7 or a fragment obtainable from SEQ ID NO:7 operably linked to a heterologous nucleic acid sequence; and (ii) regenerating a plant from the cell. In a desirable embodiment, this method also involves (iii) sexually transmitting the vector to progeny, and may include the additional step of collecting the seed produced by the progeny. The method desirably includes, for example, regenerating a plant from the germinated seed, a leaf, either green or cured, from the plant, and a method of making an article of manufacture from the leaf.

In yet another aspect, the invention features a method of reducing expression of nicotine demethylase in a tobacco plant. This method includes the steps of (i) introducing into the tobacco plant a vector containing the sequence of SEQ ID NO:7 or a fragment obtainable from SEQ ID NO:7 operably linked to a heterologous nucleic acid sequence and (ii) expressing the vector in the tobacco plant. In a desirable embodiment of this method, expression of the nicotine demethylase is silenced. In other desirable embodiment, the vector expresses RNA, such as antisense RNA or an RNA molecule capable of inducing RNA interference (RNAi).

In an additional aspect, the invention features an isolated nucleic acid molecule containing an untranslated region that hybridizes under stringent conditions to the sequence of SEQ ID NO:9 or a fragment thereof that can alter the expression pattern of a gene, reduces or alters nicotine demethylase enzymatic activity (for example, silences gene expression), or can be used as a marker to identify nicotine demethylase nucleic acid sequences. In a desirable embodiment of this aspect of the invention, the untranslated region includes (a) base pairs 4563-6347 of SEQ ID NO:4, or (b) at least 200 consecutive base pairs identical to 200 consecutive base pairs of the sequence defined by base pairs 4563-6347 of SEQ ID NO:4, or (c) a 20 base pair nucleotide portion identical in sequence to a 20 consecutive base pair portion of the sequence set forth in base pairs 4563-6347 of SEQ ID NO:4.

An additional desirable aspect of the invention features an isolated nucleic acid untranslated region containing a nucleotide sequence having 50% or more sequence identity with the sequence of SEQ ID NO:9. Desirably, the untranslated region includes the sequence of SEQ ID NO:9 or the untranslated region includes a fragment obtainable from SEQ ID NO:9 that can alter the expression pattern of a gene, reduces or alters nicotine demethylase enzymatic activity (for example, silences gene expression), or can be used as a marker to identify nicotine demethylase nucleic acid sequences. The untranslated region desirably is operably linked to a heterologous nucleic acid sequence and may be contained in an expression vector. Further, this expression vector is desirably contained in a cell, such as a plant cell, e.g., a tobacco cell. Another desirable embodiment of the invention features a plant, such as a tobacco plant, including a plant cell containing a vector that includes an isolated nucleic acid sequence that has 50% or more sequence identity with the sequence of SEQ ID NO:9 and is operably linked to a heterologous nucleic acid sequence.

The invention also features a seed, for example, a tobacco seed, from a plant, where the seed includes an untranslated region that hybridizes under stringent conditions to SEQ ID NO:9 operably linked to a heterologous nucleic acid sequence. Furthermore, the invention features a plant derived from a germinated seed containing the untranslated region of this aspect of the invention, a leaf, either green or cured, from the plant, and an article of manufacture made from the green or cured leaf.

In a further aspect, the invention features a method of expressing an untranslated region in a plant. This method involves (i) introducing into a plant cell a vector containing an isolated nucleic acid sequence that has 50% or more sequence identity with the sequence of SEQ ID NO:9 and is operably linked to a heterologous nucleic acid sequence; and (ii) regenerating a plant from the cell. In addition, this method may also involve (iii) sexually transmitting the vector to progeny, and desirably, includes the additional step of collecting the seed produced by the progeny. The method desirably includes regenerating a plant from the germinated seed, a leaf, either green or cured, from the plant, and a method of making an article of manufacture made from the green or cured leaf.

Furthermore, the invention features a method of reducing expression or altering the enzymatic activity of nicotine demethylase in a tobacco plant. This method includes the steps of (i) introducing into the tobacco plant a vector containing an isolated nucleic acid sequence that has 50% or more sequence identity with the sequence of SEQ ID NO:9 and is operably linked to a heterologous nucleic acid sequence and (ii) expressing the vector in the tobacco plant. Desirably, expression of the nicotine demethylase is silenced. In other desirable embodiments the vector expresses RNA, e.g., antisense RNA or an RNA molecule capable of inducing RNA interference (RNAi).

Another aspect of the invention features an expression vector including a nucleic acid molecule containing a nucleotide sequence encoding a nicotine demethylase, where the vector is capable of directing expression of the nicotine demethylase encoded by the isolated nucleic acid molecule. Desirably, the vector includes the sequence of SEQ ID NO:4 or SEQ ID NO:5. In other desirable embodiments, the invention features a plant or plant component, e.g., a tobacco plant or plant component (e.g., a tobacco leaf or stem), that includes a nucleic acid molecule containing a nucleotide sequence encoding a polypeptide that demethylates nicotine.

A further aspect of the invention features a cell containing an isolated nucleic acid molecule that includes a nucleotide sequence encoding a nicotine demethylase. Desirably this cell is a plant cell or a bacterial cell, such as an *Agrobacterium*.

Another aspect of the invention features a plant or plant component (e.g., a tobacco leaf or stem) containing an isolated nucleic acid molecule that encodes a nicotine demethylase, where the nucleic acid molecule is expressed in the plant or the plant component. Desirably, the plant or plant component is an angiosperm, a dicot, a solanaceous plant, or a species of *Nicotiana*. Other desirable embodiments of this aspect are a seed or a cell from the plant or plant component, as well as a leaf, either green or cured, derived from the plant and an article of manufacture made therefrom.

In an additional aspect, the invention features a tobacco plant having reduced expression of a nucleic acid sequence encoding a polypeptide, for example, one that includes the sequence of SEQ ID NO:3, and that demethylates nicotine, where the reduced expression (or a reduction in enzymatic activity) reduces the level of nornicotine in the plant. In a desirable embodiment, the tobacco plant is a transgenic plant, such as one that includes a transgene that, when expressed in the transgenic plant, silences gene expression of an endogenous tobacco nicotine demethylase.

In particular, the transgenic plant desirably includes one or more of the following: a transgene that expresses an antisense molecule of a tobacco nicotine demethylase or an RNA molecule capable of inducing RNA interference (RNAi); a transgene that, when expressed in the transgenic plant, co-suppresses expression of a tobacco nicotine demethylase; a transgene that encodes a dominant negative gene product, e.g., a mutated form the amino acid sequence of SEQ ID NO:3; a point mutation in a gene that encodes the amino acid sequence of SEQ ID NO:3; a deletion in a gene that encodes a tobacco nicotine demethylase; and an insertion in a gene that encodes a tobacco nicotine demethylase.

In other desirable embodiments, reduced expression of a nucleic acid sequence encoding a polypeptide occurs at the transcriptional level, at the translational level, or at the post-translational level.

Another aspect of the invention features a tobacco plant containing a recombinant expression cassette stably integrated into the genome thereof, where the cassette is capable of effecting a reduction in nicotine demethylase activity. Seeds of this tobacco plant are featured in a desirable embodiment. Other desirable embodiments include leaf, either green or cured, derived from this plant and an article of manufacture made therefrom.

A further aspect of the invention features a method of expressing a tobacco nicotine demethylase in a plant. This method involves (i) introducing into a plant cell an expression vector including a nucleic acid molecule containing a nucleotide sequence encoding a nicotine demethylase; and (ii) regenerating a plant from the cell. In a desirable embodiment, this method features sexually transmitting the vector to progeny, and desirably also includes the additional step of collecting the seed produced by the progeny. Additional desirable embodiments include a plant derived from the germinated seed, a leaf, either green or cured, from the plant, and an article of manufacture made from the green or cured leaf.

An additional aspect of the invention features a substantially pure tobacco nicotine demethylase. Desirably, this tobacco nicotine demethylase includes an amino acid sequence having at least 70% identity to the amino acid sequence of SEQ ID NO:3 or includes the amino acid sequence of SEQ ID NO:3. In a desirable embodiment, the tobacco nicotine demethylase, upon expression in a plant cell, converts nicotine to nornicotine. In other desirable embodiments, the tobacco nicotine demethylase, upon expression in a plant cell, is predominantly localized in leaves, or the tobacco nicotine demethylase is induced by ethylene or is expressed during plant senescence.

In a further aspect, the invention features a substantially pure antibody that specifically recognizes and binds to a tobacco nicotine demethylase. Desirably, the antibody recognizes and binds to a recombinant tobacco nicotine demethylase, e.g., one containing the sequence of SEQ ID NO:3 or a fragment thereof.

Another aspect of the invention features a method of producing a tobacco nicotine demethylase. This method involves the steps of: (a) providing a cell transformed with an isolated nucleic acid molecule containing a nucleotide sequence encoding a polypeptide that demethylates nicotine; (b) culturing the transformed cell under conditions for expressing the isolated nucleic acid molecule; and (c) recovering the tobacco nicotine demethylase. The invention also features a recombinant tobacco nicotine demethylase produced according to this method.

In an additional aspect, the invention features a method of isolating a tobacco nicotine demethylase or fragment thereof. This method involves the steps of: (a) contacting the nucleic acid molecule of SEQ ID NOS:4, 5, 7, 8, or 9 or a portion thereof with a nucleic acid preparation from a plant cell under hybridization conditions providing detection of nucleic acid sequences having at least 70% or greater sequence identity to the nucleic acid sequence of SEQ ID NOS:4, 5, 7, 8, or 9; and (b) isolating the hybridizing nucleic acid sequences.

In a further aspect, the invention features another method of isolating a tobacco nicotine demethylase or fragment thereof. This method includes the steps of: (a) providing a sample of plant cell DNA; (b) providing a pair of oligonucleotides having sequence identity to a region of a nucleic acid molecule having the sequence of SEQ ID NOS:4, 5, 7, 8, or 9; (c) contacting the pair of oligonucleotides with the plant cell DNA under conditions suitable for polymerase chain reaction-mediated DNA amplification; and (d) isolating the amplified tobacco nicotine demethylase or fragment thereof. In a desirable embodiment of this aspect, the amplification step is carried out using a sample of cDNA prepared from a plant cell. In another desirable embodiment, the tobacco nicotine demethylase encodes a polypeptide which is at least 70% identical to the amino acid sequence of SEQ ID NO:3.

A further aspect of the invention features a method for reducing the expression of tobacco nicotine demethylase in a plant or plant component. This method involves the steps of: (a) introducing into plant cells a transgene encoding a tobacco nicotine demethylase operably linked to a promoter functional in the plant cells to yield transformed plant cells; and (b) regenerating a plant or plant component from the transformed plant cells, where the tobacco nicotine demethylase is expressed in the cells of the plant or plant component, thereby reducing the expression of tobacco nicotine demethylase in a plant or plant component. In particular embodiments of this aspect of the invention, the transgene encoding the tobacco nicotine demethylase is constitutively expressed or inducibly expressed, for example, in a tissue-specific, cell-specific, or organ-specific manner. In another embodiment of this aspect of the invention, expression of the transgene co-suppresses the expression of an endogenous tobacco nicotine demethylase or any other polypeptide described herein.

A further aspect of the invention features another method for reducing the expression of tobacco nicotine demethylase or any of the other polypeptides described herein in a plant or plant component. This method includes the steps of: (a) introducing into plant cells a transgene encoding an antisense coding sequence of a tobacco nicotine demethylase or an RNA molecule capable of inducing RNA interference (RNAi) operably linked to a promoter functional in the plant cells to yield transformed plant cells; and (b) regenerating a plant or plant component from the transformed plant cells, where the antisense or an RNA molecule capable of inducing RNA interference (RNAi) of the coding sequence of the tobacco nicotine demethylase is expressed in the cells of the plant or plant component, thereby reducing the expression of tobacco nicotine demethylase in a plant or plant component. Desirably, the transgene encoding an antisense sequence or an RNA molecule capable of inducing RNA interference (RNAi) of a tobacco nicotine demethylase is constitutively expressed or is inducibly expressed, for instance in a tissue-specific, cell-specific, or organ-specific manner. In other desirable embodiments the antisense or RNA molecule capable of inducing RNAi of the coding sequence of the tobacco nicotine demethylase contains the complement of SEQ ID NO:1, SEQ ID NO:4, SEQ ID NO:5, SEQ ID NO:7, SEQ ID NO:8, SEQ ID NO:9, SEQ ID NO:62, SEQ ID NO:188, or a fragment thereof.

An additional aspect of the invention features yet another method for reducing the expression of tobacco nicotine demethylase in a plant or plant component. This method involving the steps of: (a) introducing into plant cells a transgene encoding a dominant negative gene product of a tobacco nicotine demethylase operably linked to a promoter functional in the plant cells to yield transformed plant cells; and (b) regenerating a plant or plant component from the transformed plant cells, where the dominant negative gene product of the tobacco nicotine demethylase is expressed in the cells of the plant or plant component, thereby reducing the expression of tobacco nicotine demethylase in a plant or plant component. In particular embodiments of this aspect of the invention, the transgene encoding the dominant negative gene product is constitutively expressed or is inducibly expressed, for example, in a tissue-specific, cell-specific, or organ-specific manner.

A further aspect of the invention features an additional method for reducing the expression or the enzymatic activity of tobacco nicotine demethylase in a plant cell. This method involves reducing the level of an endogenous tobacco nicotine demethylase, or its enzymatic activity, in the plant cell. Desirably, the plant cell is from a dicot, a solanaceous plant, or a species of *Nicotiana*. In desirable embodiments of this aspect, reducing the level of endogenous tobacco nicotine demethylase involves expressing a transgene encoding an antisense nucleic acid molecule or an RNA capable of inducing RNA interference (RNAi) of a tobacco nicotine demethylase in the plant cell, or involves expressing a transgene encoding a double-stranded RNA molecule of a tobacco nicotine demethylase in the plant cell. Desirably, the double-stranded RNA is an RNA sequence corresponding to the sequence of SEQ ID NO:1, SEQ ID NO:4, SEQ ID NO:5, SEQ ID NO:7, SEQ ID NO:8, SEQ ID NO:9, SEQ ID NO:62, SEQ ID NO:188, or a fragment thereof In an additional embodiment, reducing the level of endogenous tobacco nicotine demethylase involves co-suppression of the endogenous tobacco nicotine demethylase in the plant cell or involves expressing a dominant negative gene product in the plant cell. In particular, the dominant negative gene product may include a gene that encodes a mutated form of the amino acid sequence of SEQ ID NO:3 or any other amino acid sequence described herein.

In other desirable embodiments of this aspect of the invention, the endogenous tobacco nicotine demethylase includes a point mutation in a gene that encodes the amino acid sequence of SEQ ID NO:3. In other desirable embodiments reducing the level of expression of an endogenous tobacco nicotine demethylase involves a deletion in a gene that encodes a tobacco nicotine demethylase or involves an insertion in a gene that encodes a tobacco nicotine demethylase. The reduced expression may occur at the transcriptional level, at the translational level, or at the post-translational level.

A further aspect of the invention features a method for identifying a compound which alters the expression of a tobacco nicotine demethylase in a cell. This method involves the steps of: (a) providing a cell containing a gene encoding a tobacco nicotine demethylase; (b) applying a candidate compound to the cell; and (c) measuring expression of the gene encoding the tobacco nicotine demethylase, where an increase or decrease in expression relative to an untreated control sample is an indication that the compound alters expression of the tobacco nicotine demethylase.

In a desirable embodiment of this method, the gene of part (a) encodes a tobacco nicotine demethylase having at least 70% identity to the amino acid sequence of SEQ ID NO:3. Desirably, the compound decreases or increases expression of the gene that encodes the tobacco nicotine demethylase.

In another aspect, the invention features another method for identifying a compound which alters the activity of a tobacco nicotine demethylase in a cell. This method involves the steps of: (a) providing a cell expressing a gene encoding a tobacco nicotine demethylase; (b) applying a candidate compound to the cell; and (c) measuring the activity of the tobacco nicotine demethylase, where an increase or decrease in activity relative to an untreated control sample is an indication that the compound alters activity of the tobacco nicotine demethylase. In a desirable embodiment of this aspect of the invention, the gene of step (a) encodes a tobacco nicotine demethylase having at least 70% identity to the amino acid sequence of SEQ ID NO:3. Desirably, the compound decreases or increases the activity of the tobacco nicotine demethylase.

A further aspect of the invention features a cured tobacco plant or plant component containing (i) a reduced levels of nicotine demethylase or (ii) a nicotine demthylase having an altered enzymatic activity and a reduced amount of a nitrosamine. Desirably, the plant component is a tobacco leaf or tobacco stem. In a desirable embodiment, the nitrosamine is nornicotine, and the content of nornicotine desirably is less than 5 mg/g, 4.5 mg/g, 4.0 mg/g, 3.5 mg/g, 3.0 mg/g, more desirably less than 2.5 mg/g, 2.0 mg/g, 1.5 mg/g, 1.0 mg/g, more desirably less than 750 µg/g, 500 µg/g, 250 µg/g, 100 µg/g, even more desirably less than 75 µg/g, 50 µg/g, 25 µg/g, 10 µg/g, 7.0 µg/g, 5.0 µg/g, 4.0 µg/g, and even more desirably less than 2.0 µg/g, 1.0 µg/g, 0.5 µg/g, 0.4 µg/g, 0.2 µg/g, 0.1 µg/g, 0.05 µg/g, or 0.01 µg/g or wherein the percentage of secondary alkaloids relative to total alkaloid content therein is less than 90%, 70%, 50%, 30%, 10%, desirably less than 5%, 4%, 3%, 2%, 1.5%, 1%, and more desirably less than 0.75%, 0.5%, 0.25%, or 0.1%. In another desirable embodiment, the nitrosamine is N'-nitrosonornicotine (NNN), and the content of N'-NNN desirably is less than 5 mg/g, 4.5 mg/g, 4.0 mg/g, 3.5 mg/g, 3.0 mg/g, more desirably less than 2.5 mg/g, 2.0 mg/g, 1.5 mg/g, 1.0 mg/g, more desirably less than 750 µg/g, 500 µg/g, 250 µg/g, 100 µg/g, even more desirably less than 75 µg/g, 50 µg/g, 25 µg/g, 10 µg/g, 7.0 µg/g, 5.0 µg/g, 4.0 µg/g, and even more desirably less than 2.0 µg/g, 1.0 µg/g, 0.5 µg/g, 0.4 µg/g, 0.2 µg/g, 0.1 µg/g, 0.05 µg/g, or 0.01 µg/g or wherein the percentage of secondary alkaloids relative to total alkaloid content contained therein is less than 90%, 70%, 50%, 30%, 10%, desirably less than 5%, 4%, 3%, 2%, 1.5%, 1%, and more desirably less than 0.75%, 0.5%, 0.25%, or 0.1%. In additional desirable embodiments of this aspect of the invention, the cured tobacco plant or plant component is a dark tobacco, Burley tobacco, flue-cured tobacco, Virginia, air-cured tobacco, or Oriental tobacco.

Further, the cured tobacco plant or plant component of the invention desirably includes a recombinant nicotine demethylase gene, e.g., one containing the sequence of SEQ ID NO:4 or SEQ ID NO:5, or a fragment thereof. Desirably, the expression of an endogenous nicotine demethylase gene, or of any other nucleic acid sequence described herein, in the cured tobacco plant or plant component is silenced.

Another aspect of the invention features a tobacco product containing a cured tobacco plant or plant component that includes (i) reduced expression of a nicotine demethylase or any other polypeptide described herein or (ii) a nicotine demethylase or another polypeptide described herein having altered activity, and a reduced amount of a nitrosamine. Desirably, the tobacco product is smokeless tobacco, moist or dry snuff, a chewing tobaccos, cigarette products, cigar products, cigarillos, pipe tobaccos, or bidis. In particular, the tobacco product of this aspect of the invention may contain dark tobacco, milled tobacco, or include a flavoring component.

The invention also features a method of making a tobacco product, e.g., a smokeless tobacco product, containing (i) reduced expression of a nicotine demethylase or (ii) a nicotine demethylase having altered (e.g., reduced) enzymatic activity, and a reduced amount of a nitrosamine. This method involves providing a cured tobacco plant or plant component containing (i) a reduced level of nicotine demethylase or (ii) a nicotine demethylase having an altered enzymatic activity and a reduced amount of a nitrosamine and preparing the tobacco product from the cured tobacco plant or plant component.

Definitions

"Enzymatic activity" is meant to include but is not limited to demethylation, hydroxylation, epoxidation, N-oxidation, sulfooxidation, N—, S—, and O-dealkylations, desulfation, deamination, and reduction of azo, nitro, N-oxide, and other such enzymatically reactive chemical groups. Altered enzymatic activity refers to a decrease in enzymatic activity (for example, of a tobacco nicotine demethylase) by at least 10-20%, preferably by at least 25-50%, and more preferably by at least 55-95% or greater relative to the activity of a control enzyme (for example, a wild-type tobacco plant tobacco nicotine demethylase). The activity of an enzyme, such as a nicotine demethylase may be assayed using methods standard in the art, for example, using the yeast microsome assays described herein.

The term "nucleic acid" refers to a deoxyribonucleotide or ribonucleotide polymer in either single- or double-stranded form, or sense or anti-sense, and unless otherwise limited, encompasses known analogues of natural nucleotides that hybridize to nucleic acids in a manner similar to naturally occurring nucleotides. Unless otherwise indicated, a particular nucleic acid sequence includes the complementary sequence thereof. The terms "operably linked," "in operable combination," and "in operable order" refer to functional linkage between a nucleic acid expression control sequence (such as a promoter, signal sequence, or array of transcription factor binding sites) and a second nucleic acid sequence, wherein the expression control sequence affects transcription and/or translation of the nucleic acid corresponding to the second sequence. Desirably, an operably linked nucleic acid sequence refers to a fragment of a gene that is linked to other sequences of the same gene to form a full-length gene.

The term "recombinant" when used with reference to a cell indicates that the cell replicates a heterologous nucleic acid, expresses the nucleic acid or expresses a peptide, heterologous peptide, or protein encoded by a heterologous nucleic acid. Recombinant cells can express genes or gene fragments in either the sense or antisense form or an RNA molecule capable of inducing RNA interference (RNAi) that are not found within the native (non-recombinant) form of the cell. Recombinant cells can also express genes that are found in the native form of the cell, but wherein the genes are modified and re-introduced into the cell by artificial means.

A "structural gene" is that portion of a gene comprising a DNA segment encoding a protein, polypeptide or a portion thereof, and excluding, for example, the 5' sequence which drives the initiation of transcription or the 3'UTR. The structural gene may alternatively encode a nontranslatable product. The structural gene may be one which is normally found in the cell or one which is not normally found in the cell or cellular location wherein it is introduced, in which case it is termed a "heterologous gene." A heterologous gene may be derived in whole or in part from any source known to the art, including a bacterial genome or episome, eukaryotic, nuclear or plasmid DNA, cDNA, viral DNA or chemically synthesized DNA. A structural gene may contain one or more modifications that could affect biological activity or its characteristics, the biological activity or the chemical structure of the expression product, the rate of expression or the manner of expression control. Such modifications include, but are not limited to, mutations, insertions, deletions and substitutions of one or more nucleotides.

The structural gene may constitute an uninterrupted coding sequence or it may include one or more introns, bounded by the appropriate splice junctions. The structural gene may be translatable or non-translatable, including an antisense or an RNA molecule capable of inducing RNA interference (RNAi). The structural gene may be a composite of segments derived from a plurality of sources and from a plurality of gene sequences (naturally occurring or synthetic, where synthetic refers to DNA that is chemically synthesized).

An "exon" as used herein in reference to a nucleic acid sequence is meant a portion of the nucleic acid sequence of a gene, where the nucleic acid sequence of the exon encodes at least one amino acid of the gene product. An exon is typically adjacent to a noncoding DNA segment such as an intron.

An "intron" as used herein in reference to a nucleic acid sequence is meant a non-coding region of a gene that is flanked by coding regions. An intron is typically a noncoding region of a gene that is transcribed into an RNA molecule but is then excised by RNA splicing during production of the messenger RNA or other functional structural RNA.

A "3'UTR" as used herein in reference to a nucleic acid sequence is meant a non-coding nucleic acid sequence proximal to a stop codon of an exon.

"Derived from" is used to mean taken, obtained, received, traced, replicated or descended from a source (chemical and/or biological). A derivative may be produced by chemical or biological manipulation (including, but not limited to, substitution, addition, insertion, deletion, extraction, isolation, mutation, and replication) of the original source.

"Chemically synthesized," as related to a sequence of DNA, means that portions of the component nucleotides were assembled in vitro. Manual chemical synthesis of DNA may be accomplished using well-established procedures (Caruthers, *Methodology of DNA and RNA Sequencing*, (1983), Weissman (ed.), Praeger Publishers, New York, Chapter 1); automated chemical synthesis can be performed using one of a number of commercially available machines.

Optimal alignment of sequences for comparison may be conducted, for example, by the local homology algorithm of Smith and Waterman, Adv. Appl. Math. 2:482 (1981), by the homology alignment algorithm of Needleman and Wunsch, J. Mol. Biol. 48:443 (1970), by the search for similarity method of Pearson and Lipman Proc. Natl. Acad. Sci. (U.S.A.) 85: 2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by inspection.

The NCBI Basic Local Alignment Search Tool (BLAST) (Altschul et al., 1990) is available from several sources, including the National Center for Biological Information (NCBI, Bethesda, Md.) and on the internet, for use in connection with the sequence analysis programs blastp, blastn, blastx, tblastn, and tblastx. It can be accessed at ncbi.nlm.nih.gov/BLAST/. A description of how to determine sequence identity using this program is available at ncbi.nlm.nih.gov/BLAST/blasthelp.html.

The terms "substantial amino acid identity" or "substantial amino acid sequence identity" as applied to amino acid sequences and as used herein denote a characteristic of a polypeptide, wherein the peptide comprises a sequence that has at least 70 percent sequence identity, preferably 80 percent amino acid sequence identity, more preferably 90 percent amino acid sequence identity, and most preferably at least 99 to 100 percent sequence identity as compared to the protein sequence shown in FIGS. 10 to 159, 160A to 160E, 162 to 170, and 172-1 to 172-19. Desirably, for a nicotine demethylase, sequence comparison is desirably compared for a region following the cytochrome p450 motif GXRXCX(G/A) (SEQ ID NO:2265) to the stop codon of the translated peptide.

The terms "substantial nucleic acid identity" or "substantial nucleic acid sequence identity" as applied to nucleic acid sequences and as used herein denote a characteristic of a polynucleotide sequence, wherein the polynucleotide comprises a sequence that has at least 50 percent, preferably 60, 65, 70, or 75 percent sequence identity, more preferably 81 or 91 percent nucleic acid sequence identity, and most preferably at least 95, 99, or even 100 percent sequence identity as compared to a reference group over region corresponding to the first nucleic acid following the region encoding the cytochrome p450 motif GXRXCX(G/A) (SEQ ID NO:2265) to the stop codon of the translated peptide.

Another indication that nucleotide sequences are substantially identical is if two molecules hybridize to each other under stringent conditions. Stringent conditions are sequence-dependent and will be different in different circumstances. Generally, stringent conditions are selected to be about 5° C. to about 20° C., usually about 10° C. to about 15° C., lower than the thermal melting point (Tm) for the specific sequence at a defined ionic strength and pH. The Tm is the temperature (under defined ionic strength and pH) at which 50% of the target sequence hybridizes to a matched probe. Typically, stringent conditions will be those in which the salt concentration is about 0.02 molar at pH 7 and the temperature is at least about 60° C. For instance in a standard Southern hybridization procedure, stringent conditions will include an initial wash in 6×SSC at 42° C. followed by one or more additional washes in 0.2×SSC at a temperature of at least about 55° C., typically about 60° C., and often about 65° C.

Nucleotide sequences are also substantially identical for purposes of this invention when said nucleotide sequences encode polypeptides and/or proteins which are substantially identical. Thus, where one nucleic acid sequence encodes essentially the same polypeptide as a second nucleic acid sequence, the two nucleic acid sequences are substantially identical even if they would not hybridize under stringent conditions due to degeneracy permitted by the genetic code (see, Darnell et al. (1990) Molecular Cell Biology, Second Edition Scientific American Books W. H. Freeman and Company New York for an explanation of codon degeneracy and the genetic code). Protein purity or homogeneity can be indicated by a number of means well known in the art, such as polyacrylamide gel electrophoresis of a protein sample, followed by visualization upon staining. For certain purposes high resolution may be needed and HPLC or a similar means for purification may be used.

By an antibody that "specifically binds" or "specifically recognizes" a particular polypeptide, such as a tobacco nicotine demethylase, is meant an increased affinity of the antibody for the polypeptide relative to an equal amount of any other protein. Desirable antibodies are antibodies that specifically bind a polypeptide having an amino acid sequence shown in FIGS. 2 to 7 and SEQ ID NOS: 446 to 548. For example, an antibody that specifically binds to a tobacco nicotine demethylase containing the amino acid sequence of SEQ ID NO:3 desirably has an affinity for its antigen that is least 2-fold, 5-fold, 10-fold, 30-fold, or 100-fold greater than for an equal amount of any other antigen, including related antigens. Binding of an antibody to an antigen, e.g., a tobacco nicotine demethylase, may be determined by any number of standard methods in the art, e.g., Western analysis, ELISA, or co-immunoprecipitation. Antibodies that specifically bind a polypeptide, e.g., a nicotine demethylase, are also useful for purifying the polypeptide.

As used herein, the term "vector" is used in reference to nucleic acid molecules that transfer DNA segment(s) into a cell. A vector may act to replicate DNA and may reproduce independently in a host cell. The term "vehicle" is sometimes used interchangeably with "vector." The term "expression vector" as used herein refers to a recombinant DNA molecule containing a desired coding sequence and appropriate nucleic acid sequences necessary for the expression of the operably linked coding sequence in a particular host organism. Nucleic acid sequences necessary for expression in prokaryotes usually include a promoter, an operator (optional), and a ribosome binding site, often along with other sequences. Desirably, the promoter includes the sequence of SEQ ID NO:8, or a fragment thereof that drives transcription. Also desirable are promoter sequences that have at least 50%, 60%, 75%, 80%, 90%, 95%, or even 99% sequence identity to the sequence of SEQ ID NO:8 and that drive transcription. Eucaryotic cells are known to utilize promoters, enhancers, and termination and polyadenylation signals, such as the 3'UTR sequence of SEQ ID NO:9. In some instances, it has been observed that plant expression vectors require the presence of plant derived introns, such as the intron having the sequence of SEQ ID NO:7, to have stable expression. As such, the sequence of SEQ ID NO:7, or any other intron having an appropriate RNA splice junction may be used as further described herein. Desirable vectors include a nucleic acid sequences shown in FIGS. 2 to 7 and SEQ ID NOS: 446 to 2193.

For the purpose of regenerating complete genetically engineered plants with roots, a nucleic acid may be inserted into plant cells, for example, by any technique such as in vivo inoculation or by any of the known in vitro tissue culture techniques to produce transformed plant cells that can be regenerated into complete plants. Thus, for example, the insertion into plant cells may be by in vitro inoculation by pathogenic or non-pathogenic *A. tumefaciens*. Other such tissue culture techniques may also be employed.

"Plant tissue," "plant component" or "plant cell" includes differentiated and undifferentiated tissues of plants, including, but not limited to, roots, shoots, leaves, pollen, seeds, tumor tissue and various forms of cells in culture, such as single cells, protoplasts, embryos and callus tissue. The plant tissue may be in planta or in organ, tissue or cell culture.

"Plant cell" as used herein includes plant cells in planta and plant cells and protoplasts in culture. "cDNA" or "complementary DNA" generally refers to a single stranded DNA molecule with a nucleotide sequence that is complementary to an unprocessed RNA molecule containing an intron, or a processed mRNA lacking introns. cDNA is formed by the action of the enzyme reverse transcriptase on an RNA template.

"Tobacco" as used herein includes flue-cured, Virginia, Burley, dark, Oriental, and other types of plant within the genus *Nicotiana*. Seed of the genus *Nicotiana* is readily available commercially in the form of *Nicotiana tabacum*.

"Articles of manufacture" or "tobacco products" include products such as moist and dry snuff, chewing tobaccos, cigarette products, cigar products, cigarillos, pipe tobaccos, bidis, and similar tobacco-derived products.

By "gene silencing" is meant a decrease in the level of gene expression (for example, expression of a gene encoding a tobacco nicotine demethylase) by at least 30-50%, preferably by at least 50-80%, and more preferably by at least 80-95% or greater relative to the level in a control plant (for example, a wild-type tobacco plant). Reduction of such expression levels may be accomplished by employing standard methods which are known in the art including, without limitation, RNA interference, triple strand interference, ribozymes, homologous recombination, virus-induced gene silencing, antisense and co-suppression technologies, expression of a dominant negative gene product, or through the generation of mutated genes using standard mutagenesis techniques, such as those described herein. Levels of a tobacco nicotine demethylase polypeptide or transcript, or both, are monitored according to any standard technique including, but not limited to, Northern blotting, RNase protection, or immunoblotting.

By a "fragment" or "portion" of an amino acid sequence is meant at least e.g., 20, 15, 30, 50, 75, 100, 250, 300, 400, or 500 contiguous amino acids of any of the amino acid sequences shown in FIGS. 2 to 7 and SEQ ID NOS: 446 to 548. Exemplary desirable fragments are amino acids 1-313 of the sequence of SEQ ID NO:3 and amino acids 314-517 of the sequence of SEQ ID NO:3, as well as the sequence of SEQ ID NOS:2 and 63. In addition, with respect to a fragment or portion of a nucleic acid sequence, desirable fragments include at least 100, 250, 500, 750, 1000, or 1500 contiguous nucleic acids of any of the nucleic acid sequences shown in FIGS. 2 to 7 and SEQ ID NOS: 446 to 2193. Exemplary desirable fragments are nucleic acids 1-2009, 2010-2949, 2950-3946, 3947-4562, 4563-6347, and 473 1-6347 of the sequence of SEQ ID NO:4.

By a "substantially pure polypeptide" is meant a polypeptide that has been separated from most components which naturally accompany it; however, other proteins found in the microsomal fraction associated with a preparation having an enzymatic activity of at least 8.3 pKat/mg protein is also considered to be a substantially pure polypeptide. Typically, the polypeptide is substantially pure when it is at least 60%, by weight, free from the proteins and naturally-occurring organic molecules with which it is naturally associated. Preferably, the preparation is at least 75%, more preferably at least 90%, and most preferably at least 99%, by weight, the desirable polypeptide. A substantially pure polypeptide may be obtained, for example, by extraction from a natural source (for example, a tobacco plant cell); by expression of a recombinant nucleic acid encoding the polypeptide; or by chemically synthesizing the protein. Purity can be measured by any appropriate method, for example, column chromatography, polyacrylamide gel electrophoresis, or by HPLC analysis.

By "isolated nucleic acid molecule." is meant a nucleic acid sequence free from the nucleic acid sequences that naturally flank the sequence of the nucleic acid molecule in the genome of an organism.

By "transformed cell" is meant a cell into which (or into an ancestor of which) has been introduced, by means of recombinant DNA techniques, a DNA molecule, for example, a DNA molecule encoding a tobacco nicotine demethylase or any of the nucleic acid sequences disclosed herein (e.g., the nucleic acid sequences shown in FIGS. 2 to 7 and SEQ ID NOS: 446 to 2193).

By a "tobacco nicotine demethylase" or "nicotine demethylase" as used herein, is meant a polypeptide that is substantially identical to the sequence of SEQ ID NO:3. Desirably, a tobacco nicotine demethylase is capable of converting nicotine ($C_{10}H_{14}N_2$, also referred to as 3-(1-methyl-2-pyrrolidinyl)pyridine) to nornicotine ($C_9H_{12}N_2$). The activity of a tobacco nicotine demethylase may be assayed using methods standard in the art, such as by measuring the demethylation of radioactive nicotine by yeast-expressed microsomes, as described herein.

As provided herein, the terms "cytochrome p450" and "p450" are used interchangeably.

Other features and advantages of the invention will be apparent from the following Detailed Description, the drawings, and the claims.

BRIEF DESCRIPTION OF THE DRAWINGS

FIG. 4A shows a comparison of Sequence Groups.
FIG. 4B shows a comparison of Sequence Groups.
FIG. 4C shows a comparison of Sequence Groups.
FIG. 5A shows a comparison of Sequence Groups.
FIG. 5B shows a comparison of Sequence Groups.
FIG. 5C shows a comparison of Sequence Groups.
FIG. 5D shows a comparison of Sequence Groups.
FIG. 5E shows a comparison of Sequence Groups.
FIG. 5F shows a comparison of Sequence Groups.
FIG. 5G shows a comparison of Sequence Groups.
FIG. 5H shows a comparison of Sequence Groups.
FIG. 5I shows a comparison of Sequence Groups.
FIG. 5J shows a comparison of Sequence Groups.
FIG. 5K shows a comparison of Sequence Groups.
FIG. 6A shows a comparison of Sequence Groups.
FIG. 6B shows a comparison of Sequence Groups.
FIG. 6C shows a comparison of Sequence Groups.
FIG. 6D shows a comparison of Sequence Groups.
FIG. 6E shows a comparison of Sequence Groups.

FIG. 7 is a schematic diagram showing the cloning of cytochrome p450 cDNA fragments by PCR. Primers used for the cloning are listed: DM (SEQ ID NO: 2255), DM4 (SEQ ID NO: 2256), DM12 (SEQ ID NO: 2257), DM13 (SEQ ID NO: 2258), DM17 (SEQ ID NO: 2259), OLIGO d(T) (SEQ ID NO: 2260), T7 (SEQ ID NO: 2261), and SP6 (SEQ ID NO: 2262).

DETAILED DESCRIPTION

Figure 1:
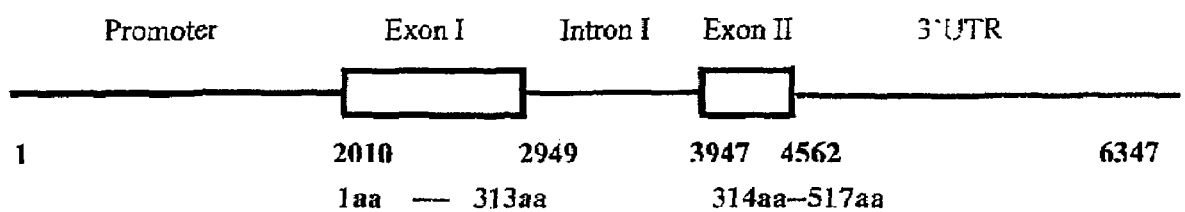
FIG. 1 is a schematic diagram of the genomic structure of the tobacco nicotine demethylase gene.
Figure 2:
FIG. 2 is a gel electrophoresis image showing PCR products of tobacco lines with the Geno full-length ("FL") primer set.
Figure 3:
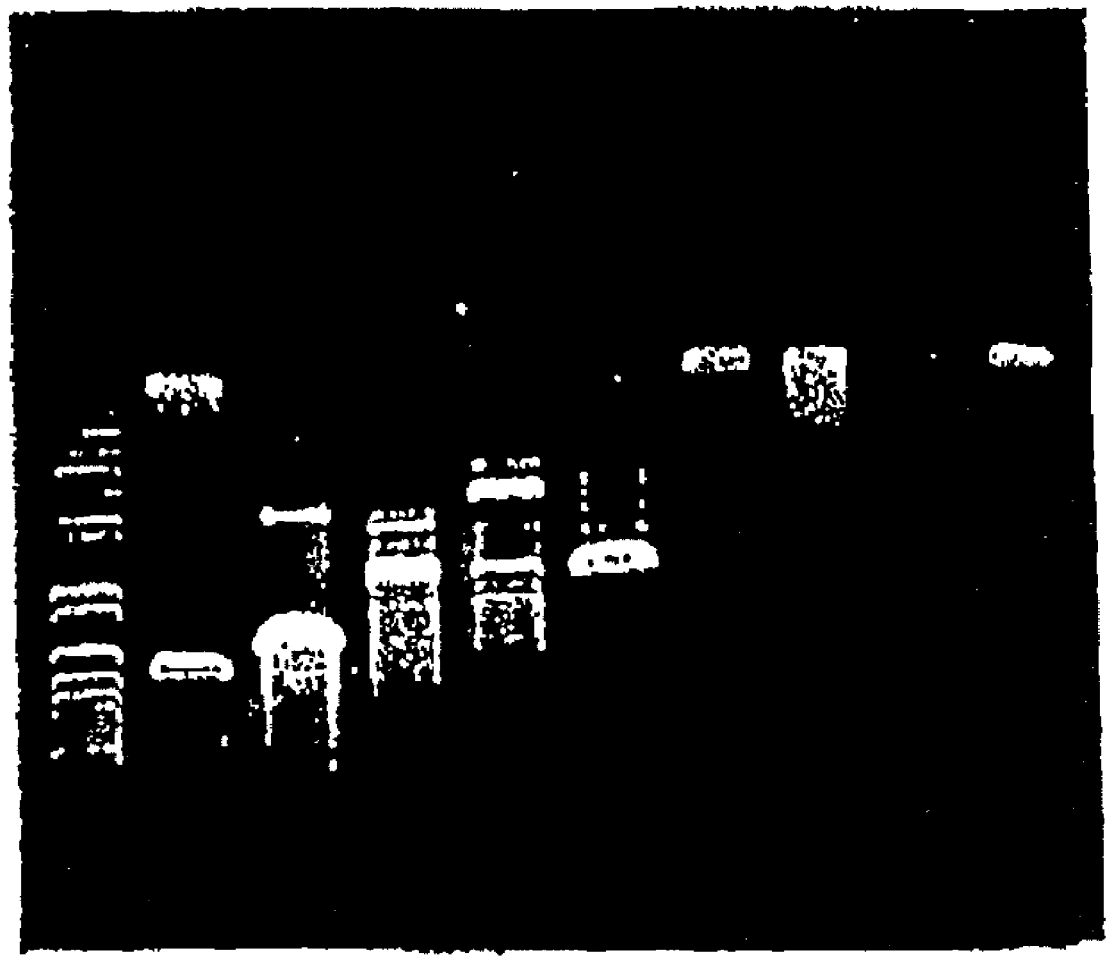
FIG. 3 is a gel electrophoresis image showing PCR products of tobacco lines with primer sets (1), (2), (3), and (4) as stated in Example 17. The approximate sizes of the bands are 3,500 nucleotides (nt) for FL, 2,600 nt for (1), 1,400 nt for (2), 600 nt for (3), and 1,400 nt for (4).

Traditionally, numerous steps were involved in the development of any novel, desirable plant germplasm. Plant breeding begins with the analysis and definition of problems and weaknesses of the current germplasm, the establishment of program goals, and the definition of specific breeding objectives. The next step is selection of germplasm that possess the traits to meet the program goals. The goal is to combine in a single variety an improved combination of desirable traits from the parental germplasm. Desirable traits include, for example, higher seed yield, resistance to diseases and insects, tolerance to drought and heat, and better agronomic qualities. However, these processes, which lead to the final step of marketing and distribution, can take six to twelve years from the time the first cross is made. Accordingly, development of new varieties is a time-consuming process that requires precise forward planning, efficient use of resources, and a minimum of changes in direction.

Improvement of plant varieties through genetic transformation has become increasingly important for modern plant breeding. Genes of potential commercial interest, such as genes conferring specific, desired plant traits of disease resistance, insect resistance, or improved quality, may be incorporated into crop species through various gene transfer technologies. The ability to manipulate gene expression provides a means of producing new characteristics in transformed plants. In some situations high or increased levels of gene expression may be desired. For example, it is desirable to increase production of a protein that itself maximizes the disease resistance, yield, flavor, or any other commercially desirable attribute of a plant. Similarly, the regulation of endogenous gene expression by, for example, gene silencing may result in more valuable plants or plant products.

During tobacco ripening or curing, the activation, up-regulation, or down-regulation of any of the genes identified as ethylene-induced or senescence-related (e.g., those having the sequence of SEQ ID NOS:4, 40, 44, 52, 54, 60, 70, 104, 138, 140, 158, 162, 188, 212, 226, 234, and 288) may affect those metabolic pathways involved in the formation of numerous secondary metabolites including terpenoids, polyphenols, alkaloids, etc. that affect end-product quality traits (e.g., disease resistance, insect resistance, improved quality, modified aroma, modified flavor, and the like). Similarly affected by the genes identified herein may be the metabolic pathways associated with the rate and type of dry matter accumulated during senescence or the partitioning of dry matter within the plant during senescence. Changes in the rate and type of starch accumulation, lignin formation, cellulose deposition, and sugar translocation could be demonstrated. The control of genes identified herein may also affect those metabolic pathways involved in determining senescence rates, the uniformity of senescence within a leaf and among leaves of a single plant, and the induction of senescence by artificial or natural means. The senescence inducing agents or activities that stimulate or activate the genes identified herein include, for example, chemicals such as dilute peroxides, pesticides, herbicides, growth regulators, heat treatments, wounding, or gases such as ozone and elevated concentrations of carbon dioxide.

Identifying Tobacco Constitutively Expressed, or Ethylene or Senescence Induced Sequences In accordance with the present invention, RNA was extracted from *Nicotiana* tissue of converter and non-converter *Nicotiana* lines. The extracted RNA was then used to create cDNA. Nucleic acid sequences of the present invention were then generated using two strategies.

In the first strategy, the poly A enriched RNA was extracted from plant tissue and cDNA was made by reverse transcription PCR. The single strand cDNA was then used to create p450 specific PCR populations using degenerate primers plus a oligo d(T) reverse primer. The primer design was based on the highly conserved motifs of other plant cytochrome p450 gene sequences. Examples of specific degenerate primers are set forth in FIG. 1 of the US 2004/0103449 A1, US 2004/0111759 A1, and US 2004/0117869 A1 patent application publications, which are hereby incorporated by reference. The sequence of fragments from plasmids containing appropriate size inserts was further analyzed. These size inserts typically ranged from about 300 to about 800 nucleotides depending on which primers were used.

In a second strategy, a cDNA library was initially constructed. The cDNA in the plasmids was used to create p450 specific PCR populations using degenerate primers plus T7 primer on plasmid as reverse primer. As in the first strategy, the sequence of fragments from plasmids containing appropriate size inserts was further analyzed.

*Nicotiana* plant lines known to produce high levels of nornicotine (converter) and plant lines having low levels of nornicotine may be used as starting materials. Leaves can then be removed from plants and treated with ethylene to activate p450 enzymatic activities defined herein. Total RNA is extracted using techniques known in the art. cDNA fragments can then be generated using PCR (RT-PCR) with the oligo d(T) primer (SEQ ID NO:2260) as described in FIG. 161. The cDNA library can then be constructed as more fully described in examples herein.

The conserved region of p450 type enzymes was used as a template for degenerate primers, examples of which are shown in FIG. 161. Using degenerate primers, p450 specific bands were amplified by PCR. Bands indicative for p450-like enzymes were identified by DNA sequencing. PCR fragments were characterized using BLAST search, alignment or other tools to identify appropriate candidates.

Sequence information from identified fragments was used to develop PCR primers. These primers in combination with plasmid primers in cDNA library were used to clone full-length p450 genes. Large-scale Southern reverse analysis was conducted to examine the differential expression for all fragment clones obtained and in some cases full-length clones. In this aspect of the invention, these large-scale reverse Southern assays can be conducted using labeled total cDNAs from different tissues as a probe to hybridize with cloned DNA fragments in order to screen all cloned inserts. Nonradioactive and radioactive ($P^{32}$) Northern blotting assays were also used to characterize cloned p450 fragments and full-length clones.

Once plant cells expressing the desired level of p450 enzyme are obtained, plant tissues and whole plants can be regenerated therefrom using methods and techniques well-known in the art. The regenerated plants are then reproduced by conventional means and the introduced genes can be transferred to other strains and cultivars by conventional plant breeding techniques.

Ethylene-induced or senescence-related genes, for example, those identified in SEQ ID NOS:4, 40, 44, 52, 54, 60, 70, 104, 138, 140, 158, 162, 188, 212, 226, 234, and 288, may encode enzymes that are important determinants of tobacco leaf quality parameters important for a variety of tobacco products. The tobacco products include moist or dry snuff, chewing tobaccos, cigarettes, cigars, cigarillos, pipe tobaccos, bidis, and similar smoking products. The leaf quality parameters may include: visual attributes such as color, surface uniformity, texture, or variegation; structural or physical characteristics as exemplified by lamina-to-stem ratio, oiliness, cigarette filling potential, bulk density, moisture retention, and pliability; chemical or biochemical traits related to flavor, aroma, fermentation capability, burn rates, burn temperatures, artificial flavor absorption and release; and generation of smoke constituents including tar or particulate matter, alkaloids, and other similar attributes. The enzymatic reactions resulting from these ethylene-induced or senescence-related genes may also produce secondary metabolites influencing pathogen or insect interactions that affect tobacco leaf yield and quality. For example, Wagner, et al. (*Nature Biotechnology,* 19:371-374, 2001) showed that suppression of a p450 hydroxylase gene greatly increases the accumulation of cembratiene-ol, a secondary metabolite influencing aphid resistance.

Generation of Antibodies

Peptide specific antibodies were made by deriving their amino acid sequence and selecting peptide regions that were antigenic and unique relative to other clones. Rabbit antibodies were made to synthetic peptides conjugated to a carrier protein. Western blotting analyses or other immunological methods were performed on plant tissue using these antibodies. In addition, peptide specific antibodies were made for several full-length clones by deriving their amino acid sequence and selecting peptide regions that were potentially antigenic and were unique relative to other clones. Rabbit antibodies were made to synthetic peptides conjugated to a carrier protein. Western blotting analyses were performed using these antibodies.

Downregulating Gene Expression and Altering Enzymatic Activity

Plants having decreased expression of a polypeptide are generated according to standard gene silencing methods. (For reviews, see Arndt and Rank, *Genome* 40:785-797, 1997; Turner and Schuch, *Journal of Chemical Technology and Biotechnology* 75:869-882, 2000; and Klink and Wolniak, *Journal of Plant Growth Regulation* 19(4):371-384, 2000.) In particular, tobacco nicotine demethylase nucleic acid sequences (e.g., SEQ ID NOS:4, 5, 7, 8, and 9, or fragments thereof such as the sequence of SEQ ID NOS:1 and 62), as well as substantially identical nucleic acid sequences (e.g., the sequence of SEQ ID NO:188) can be used to alter tobacco phenotypes or tobacco metabolites, for example, nornicotine in any *Nicotiana* species. Decreased expression of a tobacco nicotine demethylase gene may be achieved using, for example, RNA interference (RNAi) (Smith et al., *Nature* 407:319-320, 2000; Fire et al., *Nature* 391:306-311, 1998; Waterhouse et al., *PNAS* 95:13959-13964, 1998; Stalberg et al., *Plant Molecular Biology* 23:671-683, 1993; Brignetti et al., *EMBO J.* 17:6739-6746, 1998; Allen et al., *Nature Biotechnology* 22: 1559-1566, 2004); virus-induced gene silencing ("VIGS") (Baulcombe, *Current Opinions in Plant Biology,* 2:109-113, 1999; Cogoni and Macino, *Genes Dev* 10: 638-643, 2000; Ngelbrecht et al., *PNAS* 91:10502-10506, 1994); silencing the target gene by transferring a plant endogenous gene in the sense orientation (Jorgensen et al., *Plant Mol Biol* 31:957-973, 1996); expression of antisense gene; homologous recombination (Ohl et al., Homologous Recombination and Gene Silencing in Plants. Kluwer, Dordrecht, The Netherlands, 1994); Cre/lox systems (Qin et al., *PNAS* 91: 1706-1710, 1994; Koshinsky et al., *The Plant Journal* 23: 715-722, 2000; Chou, et al., *Plant and Animal Genome VII Conference Abstracts. San Diego, Calif.*, 17-21 Jan., 1999); gene trapping and T-DNA tagging (Burns et al., *Genes Dev.* 8: 1087-1105, 1994; Spradling, et al., *PNAS* 92:10824-10830, 1995; Skarnes et al., *Bio/Technology* 8, 827-831, 1990; Sundaresan, et al., *Genes Dev.* 9: 1797-1810, 1995); and any of the other possible gene silencing systems that are available in the science areas that result in the downregulation of expression of a tobacco polypeptide or in a reduction in its enzymatic activity. As further provided herein, any of the nucleic acid sequences provided herein may be down regulated or up regulated using techniques described herein and other technologies found in the art. Exemplary methods are described in more detail below.

RNA Interference

RNA interference ("RNAi") is a generally applicable process for inducing potent and specific post-translational gene silencing in many organisms including plants (see, e.g., Bosher et al., *Nat. Cell Bid.* 2:E31-36, 2000; and Tavemarakis et al., *Nat. Genetics* 24:180-183, 2000). RNAi involves introduction of RNA with partial or fully double-stranded character into the cell or into the extracellular environment. Inhibition is specific in that a nucleotide sequence from a portion of the target gene (e.g., a tobacco nicotine demethylase) is chosen to produce inhibitory RNA. The chosen portion generally encompasses exons of the target gene, but the chosen portion may also include untranslated regions (UTRs), as well as introns (e.g., the sequence of SEQ ID NO:7, or a nucleic acid sequence from a desired plant gene, such as any nucleic acid sequence shown in FIGS. 2 to 7 and SEQ ID NOS: 446 to 2193).

For example, to construct transformation vectors that produce RNAs capable of duplex formation, two nucleic acid sequences, one in the sense and the other in the antisense orientation, may be operably linked, and placed under the control of a strong viral promoter, such as CaMV 35S or the promoter isolated from cassava brown streak virus (CBSV). However, use of the endogenous promoter, such as the nicotine demethylase promoter having the sequence of SEQ ID NO:8, or a fragment thereof that drives transcription, may also be desirable. The length of the tobacco nicotine demethylase nucleic acid sequences included in such a construct is desirably at least 25 nucleotides, but may encompass a sequence that includes up to the full-length tobacco nicotine demethylase gene.

Constructs that produce RNAs capable of duplex formation may be introduced into the genome of a plant, such as a tobacco plant, by Agrobacterium-mediated transformation (Chuang et al., *Proc. Natl. Acad. Sci. USA* 97:4985-4990, 2000), causing specific and heritable genetic interference in a tobacco nicotine demethylase. The double-stranded RNA may also be directly introduced into the cell (i.e., intracellularly) or introduced extracellularly, for example, by bathing a seed, seedling, or plant in a solution containing the double-stranded RNA.

Depending on the dose of double-stranded RNA material delivered, the RNAi may provide partial or complete loss of function for the target gene. A reduction or loss of gene expression in at least 99% of targeted cells may be obtained. In general, lower doses of injected material and longer times after administration of dsRNA result in inhibition in a smaller fraction of cells.

The RNA used in RNAi may comprise one or more strands of polymerized ribonucleotide; it may include modifications to either the phosphate-sugar backbone or the nucleoside. The double-stranded structure may be formed by a single self-complementary RNA strand or by two complementary RNA strands and RNA duplex formation may be initiated either inside or outside the cell. The RNA may be introduced in an amount which allows delivery of at least one copy per cell. However, higher doses (e.g., at least 5, 10, 100, 500 or 1000 copies per cell) of double-stranded material may yield more effective inhibition. Inhibition is sequence-specific in that nucleotide sequences corresponding to the duplex region of the RNA are targeted for genetic inhibition. RNA containing a nucleotide sequences identical to a portion of the target gene is preferred for inhibition. RNA sequences with insertions, deletions, and single point mutations relative to the target sequence may also be effective for inhibition. Thus, sequence identity may be optimized by alignment algorithms known in the art and calculating the percent difference between the nucleotide sequences. Alternatively, the duplex region of the RNA may be defined functionally as a nucleotide sequence that is capable of hybridizing with a portion of the target gene transcript.

In addition, the RNA used for RNAi may be synthesized either in vivo or in vitro. For example, endogenous RNA polymerase in the cell may mediate transcription in vivo, or cloned RNA polymerase can be used for transcription in vivo or in vitro. For transcription from a transgene in vivo or an expression construct, a regulatory region may be used to transcribe the RNA strand (or strands).

Triple Strand Interference

Endogenous tobacco nicotine demethylase gene expression or expression of a nucleic acid fragment from a desired plant gene, such as any nucleic acid sequence shown in FIGS. 2 to 7 and SEQ ID NOS: 446 to 2193, may also be downregulated by targeting deoxyribonucleotide sequences complementary to the regulatory region of a tobacco gene (e.g., promoter or enhancer regions) to form triple helical structures that prevent transcription of the tobacco gene in target cells. (See generally, Helene, *Anticancer Drug Des.* 6:569-584, 1991; Helene et al., *Ann. N.Y. Acad. Sci.* 660:27-36, 1992; and Maher, *Bioassays* 14:807-8 15, 1992.)

Nucleic acid molecules used in triple helix formation for the inhibition of transcription are preferably single stranded and composed of deoxyribonucleotides. The base composition of these oligonucleotides should promote triple helix formation via Hoogsteen base pairing rules, which generally require sizable stretches of either purines or pyrimidines to be present on one strand of a duplex. Nucleotide sequences may be pyrimidine-based, which will result in TAT and CGC triplets across the three associated strands of the resulting triple helix. The pyrimidine-rich molecules provide base complementarity to a purine-rich region of a single strand of the duplex in a parallel orientation to that strand. In addition, nucleic acid molecules may be chosen that are purine-rich, for example, containing a stretch of G residues. These molecules will form a triple helix with a DNA duplex that is rich in GC pairs, in which the majority of the purine residues are located on a single strand of the targeted duplex, resulting in CGC triplets across the three strands in the triplex.

Alternatively, the potential sequences that can be targeted for triple helix formation may be increased by creating a "switchback" nucleic acid molecule. Switchback molecules are synthesized in an alternating 5'-3', 3'-5' manner, such that they base pair with first one strand of a duplex and then the other, eliminating the necessity for a sizable stretch of either purines or pyrimidines to be present on one strand of a duplex.

Ribozymes

Ribozymes are RNA molecules that act as enzymes and can be engineered to cleave other RNA molecules. A ribozyme may be designed to specifically pair with virtually any target RNA and cleave the phosphodiester backbone at a specific location, thereby functionally inactivating the target RNA. The ribozyme itself is not consumed in this process and can act catalytically to cleave multiple copies of mRNA target molecules. Accordingly, ribozymes may also be used as a means to downregulate expression of a tobacco nicotine demethylase. The design and use of target RNA-specific ribozymes is described in Haseloff et al. (*Nature* 334:585-591, 1988). Preferably, the ribozyme includes at least about 20 continuous nucleotides complementary to the target sequence (e.g., a tobacco nicotine demethylase or a nucleic acid fragment from a desired plant gene, such as any nucleic acid sequence shown in FIGS. 2 to 7 and SEQ ID NOS: 446 to 2193) on each side of the active site of the ribozyme.

In addition, ribozyme sequences may also be included within an antisense RNA to confer RNA-cleaving activity upon the antisense RNA and, thereby, increasing the effectiveness of the antisense construct.

Homologous Recombination

Gene replacement technology is another desirable method for downregulating expression of a given gene. Gene replacement technology is based upon homologous recombination (see, Schnable et al., *Curr. Opinions Plant Biol.* 1:123-129, 1998). The nucleic acid sequence of the enzyme of interest such as a tobacco nicotine demethylase or a polypeptide encoded by any nucleic acid sequence shown in FIGS. 2 to 7 and SEQ ID NOS: 446 to 2193 can be manipulated by mutagenesis (e.g., insertions, deletions, duplications or replacements) to decrease enzymatic function. The altered sequence can then be introduced into the genome to replace the existing, e.g., wild-type, gene via homologous recombination (Puchta et al., *Proc. Natl. Acad. Sci. USA* 93:5055-5060, 1996; and Kempin et al., *Nature* 389: 802-803, 1997). Alternatively, an endogenous tobacco nicotine demethylase gene may be replaced with a gene that does not have demethylase activity, for example, the sequence of SEQ ID NO:188.

Co-Suppression

A further desirable method of silencing gene expression is co-suppression (also referred to as sense suppression). This technique, which involves introduction of a nucleic acid, e.g., a nucleic acid fragment from a desired plant gene, such as any nucleic acid sequence shown in FIGS. 2 to 7 and SEQ ID NOS: 446 to 2193, configured in the sense orientation, has been shown to effectively block the transcription of target genes (see, for example, Napoli et al., *Plant Cell*, 2:279-289, 1990 and Jorgensen et al., U.S. Pat. No. 5,034,323).

Generally, sense suppression involves transcription of the introduced sequence. However, co-suppression may also occur where the introduced sequence contains no coding sequence per se, but only intron or untranslated sequences or other such sequences substantially identical to sequences present in the primary transcript of the endogenous gene to be repressed. The introduced sequence generally will be substantially identical to the endogenous gene targeted for repression. Such identity is typically greater than about 50%, but higher identities (for example, 80% or even 95%) are preferred because they result in more effective repression. The effect of co-suppression may also be applied to other proteins within a similar family of genes exhibiting homology or substantial homology. Segments from a gene from one plant can be used directly, for example, to inhibit expression of homologous genes in different plant species.

In sense suppression, the introduced sequence, requiring less than absolute identity, need not be full length, relative to either the primary transcription product or to fully processed mRNA. A higher degree of sequence identity in a shorter than full-length sequence compensates for a longer sequence of lesser identity. Furthermore, the introduced sequence need not have the same intron or exon pattern, and identity of non-coding segments may be equally effective. Sequences of at least 50 base pairs are preferred, with introduced sequences of greater length being more preferred (see, for example, those methods described by Jorgensen et al., U.S. Pat. No. 5,034,323).

Antisense Suppression

In antisense technology, a nucleic acid segment from the desired plant gene, such as any nucleic acid sequence shown in FIGS. 2 to 7 and SEQ ID NOS: 446 to 2193, is cloned and operably linked to an expression control region such that the antisense strand of RNA is synthesized. The construct is then transformed into plants and the antisense strand of RNA is produced. In plant cells, it has been shown that antisense RNA inhibits gene expression.

The nucleic acid segment to be introduced in antisense suppression is generally substantially identical to at least a portion of the endogenous gene or genes to be repressed, but need not be identical. The nucleic acid sequences of the tobacco nicotine demethylase disclosed herein may be included in vectors designed such that the inhibitory effect applies to other proteins within a family of genes exhibiting homology or substantial homology to the target gene. Segments from a gene from one plant can be used, for example, directly to inhibit expression of homologous genes in different tobacco varieties.

The introduced sequence also need not be full length relative to either the primary transcription product or to fully processed mRNA. Generally, higher homology can be used to compensate for the use of a shorter sequence. Moreover, the introduced sequence need not have the same intron or exon pattern, and homology of non-coding segments will be equally effective. In general, such an antisense sequence will usually be at least 15 base pairs, preferably about 15-200 base pairs, and more preferably 200-2,000 base pairs in length or greater. The antisense sequence may be complementary to all or a portion of the gene to be suppressed, and, as appreciated by those skilled in the art, the particular site or sites to which the antisense sequence binds as well as the length of the antisense sequence will vary, depending upon the degree of inhibition desired and the uniqueness of the antisense sequence. A transcriptional construct expressing a plant negative regulator antisense nucleotide sequence includes, in the direction of transcription, a promoter, the sequence coding for the antisense RNA on the sense strand, and a transcriptional termination region. Antisense sequences may be constructed and expressed as described, for example, in van der Krol et al. (*Gene* 72: 45-50, 1988); Rodermel et al. (*Cell* 55: 673-681, 1988); Mol et al. (*FEBS Lett.* 268: 427-430, 1990); Weigel and Nilsson (*Nature* 377: 495-500, 1995); Cheung et al., (*Cell* 82: 383-393, 1995); and Shewmaker et al. (U.S. Pat. No. 5,107,065).

Dominant Negatives

Transgenic plants expressing a transgene encoding a dominant negative gene product of a tobacco gene product may be assayed in artificial environments or in the field to demonstrate that the transgene confers downregulates a tobacco gene product in the transgenic plant. Dominant negative transgenes are constructed according to methods known in the art. Typically, a dominant negative gene encodes a mutant negative regulator polypeptide of a tobacco gene product which, when overexpressed, disrupts the activity of the wild-type enzyme.

Mutants

Plants having decreased expression or enzymatic activity of a tobacco gene product may also be generated using standard mutagenesis methodologies. Such mutagenesis methods include, without limitation, treatment of seeds with ethyl methylsulfate (Hildering and Verkerk, In, The use of induced mutations in plant breeding. Pergamon press, pp 317-320, 1965) or UV-irradiation, X-rays, and fast neutron irradiation (see, for example, Verkerk, *Neth. J. Agric. Sci.* 19:197-203, 1971; and Poehlman, Breeding Field Crops, Van Nostrand Reinhold, New York (3.sup.rd ed), 1987), use of transposons (Fedoroff et al., 1984; U.S. Pat. Nos. 4,732,856 and 5,013,658), as well as T-DNA insertion methodologies (Hoekema et al., 1983; U.S. Pat. No. 5,149,645). The types of mutations that may be present in a tobacco gene include, for example, point mutations, deletions, insertions, duplications, and inversions. Such mutations desirably are present in the coding region of a tobacco gene; however mutations in the promoter region, and intron, or an untranslated region of a tobacco gene may also be desirable.

For instance, T-DNA insertional mutagenesis may be used to generate insertional mutations in a tobacco gene to down-regulate the expression of the gene. Theoretically, about 100,000 independent T-DNA insertions are required for a 95% probability of getting an insertion in any given gene (McKinnet, *Plant J.* 8: 613-622, 1995; and Forsthoefel et al., *Aust. J. Plant Physiol.* 19:353-366, 1992). T-DNA tagged lines of plants may be screened using polymerase chain reaction (PCR) analysis. For example, a primer can be designed for one end of the T-DNA and another primer can be designed for the gene of interest and both primers can be used in the PCR analysis. If no PCR product is obtained, then there is no insertion in the gene of interest. In contrast, if a PCR product is obtained, then there is an insertion in the gene of interest.

Expression of a mutated tobacco gene product may be evaluated according to standard procedures (for example, those described herein) and, optionally, may be compared to expression of the non-mutated enzyme. When compared to non-mutated plants, mutated plants having decreased expression of a gene encoding a tobacco gene product are desirable embodiments of the present invention. A plant having a mutation in any of the nucleic acid sequences described herein may be used in a breeding program as described herein.

Overexpression of Constitutive, or Ethylene or Senescence Induced Sequences

Overexpression of a nucleic acid sequence of the invention (e.g., a nucleic acid sequence shown in FIGS. 2 to 7 and SEQ ID NOS: 446 to 2193, or fragments thereof) can be used to increase desirable traits in the *Nicotiana* line or in a tobacco product made from a plant of that line. In particular, overexpression of the nucleic acid sequences of the invention, and/or their translation products, may be used to increase the biosynthesis of desirable flavor and aroma products that result from secondary metabolites. Further overexpression of a nucleic acid sequence that encodes a tobacco polypeptide may be used to increase expression of the polypeptide within *Nicotiana* lines.

Additional desirable traits that may be conferred to a *Nicotiana* line by overexpressing a nucleic acid sequence of the invention include resistance to bacterial wilt, Granville wilt, Fusarium wilt, potato virus Y, tobacco mosaic virus, tobacco etch virus, tobacco vein mottling virus, alfalfa mosaic viruses, wildfire, root-knot nematode, Southern root knot nematode, cyst nematode, black root rot, blue mold, race 0 black shank fungus, and race 1 black shank fungus. Other desirable traits that may be enhanced in a *Nicotiana* plant by overxpressing a nucleic acid sequence of the invention include increased yield and/or grade, better curability, harve-stability, holding ability, leaf quality, or curing quality, increased or reduced height, altered time of maturity (e.g., early maturing, early to medium maturing, medium maturing, medium to late maturing, or late maturing), increased or reduced stalk size, and an increase or reduction in the number of leaves per plant.

Plant Promoters

A desirable promoter is a caulimovirus promoter, for instance, a cauliflower mosaic virus (CaMV) promoter or the cassava vein mosaic virus (CsVMV) promoter. These promoters confer high levels of expression in most plant tissues, and the activity of these promoters is not dependent on virally encoded proteins. CaMV is a source for both the 35 S and 19 S promoters. Examples of plant expression constructs using these promoters are known in the art. In most tissues of transgenic plants, the CaMV 35 S promoter is a strong promoter. The CaMV promoter is also highly active in monocots. Moreover, activity of this promoter can be further increased (i.e., between 2-10 fold) by duplication of the CaMV 35S promoter.

Other useful plant promoters include, without limitation, the nopaline synthase (NOS) promoter, the octopine synthase promoter, figwort mosiac virus (FMV) promoter, the rice actin promoter, and the ubiquitin promoter system.

Exemplary monocot promoters include, without limitation, commelina yellow mottle virus promoter, sugar cane badna virus promoter, rice tungro bacilliform virus promoter, maize streak virus element, and wheat dwarf virus promoter.

For certain applications, it may be desirable to produce a tobacco gene product, such as a dominant negative mutant gene product, in an appropriate tissue, at an appropriate level, or at an appropriate developmental time. For this purpose, there are assortments of gene promoters, each with its own distinct characteristics embodied in its regulatory sequences, shown to be regulated in response to inducible signals such as the environment, hormones, and/or developmental cues. These include, without limitation, gene promoters that are responsible for heat-regulated gene expression, light-regulated gene expression (for example, the pea rbcS-3A; the maize rbcS promoter; the chlorophyll a/b-binding protein gene found in pea; or the Arabssu promoter), hormone-regulated gene expression (for example, the abscisic acid (ABA) responsive sequences from the Em gene of wheat; the ABA-inducible HVA1 and HVA22, and rd29A promoters of barley and *Arabidopsis*; and wound-induced gene expression (for example, of wunI), organ-specific gene expression (for example, of the tuber-specific storage protein gene; the 23-kDa zein gene from maize described by; or the French bean β-phaseolin gene), or pathogen-inducible promoters (for example, the PR-1, prp-1, or β-1,3 glucanase promoters, the fungal-inducible wirla promoter of wheat, and the nematode-inducible promoters, TobRB7-5A and Hmg-1, of tobacco and parsley, respectively).

Plant Expression Vectors

Typically, plant expression vectors include (1) a cloned plant gene under the transcriptional control of 5' and 3' regulatory sequences and (2) a dominant selectable marker. Such plant expression vectors may also contain, if desired, a promoter regulatory region (for example, one conferring inducible or constitutive, pathogen- or wound-induced, environmentally- or developmentally-regulated, or cell- or tissue-specific expression), a transcription initiation start site, a ribosome binding site, an RNA processing signal, a transcription termination site, and/or a polyadenylation signal.

Plant expression vectors may also optionally include RNA processing signals, e.g., introns, which have been shown to be important for efficient RNA synthesis and accumulation. The location of the RNA splice sequences can dramatically influence the level of transgene expression in plants. In view of this fact, an intron may be positioned upstream or downstream of a tobacco nicotine demethylase coding sequence in the transgene to alter levels of gene expression.

In addition to the aforementioned 5' regulatory control sequences, the expression vectors may also include regulatory control regions which are generally present in the 3' regions of plant genes. For example, the 3' terminator region may be included in the expression vector to increase stability of the mRNA. One such terminator region may be derived from the PI-II terminator region of potato. In addition, other commonly used terminators are derived from the octopine or nopaline synthase signals.

The plant expression vector also typically contains a dominant selectable marker gene used to identify those cells that have become transformed. Useful selectable genes for plant systems include the aminoglycoside phosphotransferase gene of transposon Tn5 (Aph II), genes encoding antibiotic resistance genes, for example, those encoding resistance to hygromycin, kanamycin, bleomycin, neomycin, G418, streptomycin, or spectinomycin. Genes required for photosynthesis may also be used as selectable markers in photosynthetic-deficient strains. Finally, genes encoding herbicide resistance may be used as selectable markers; useful herbicide resistance genes include the bar gene encoding the enzyme phosphinothricin acetyltransferase and conferring resistance to the broad-spectrum herbicide Basta® (Bayer Cropscience Deutschland GmbH, Langenfeld, Germany). Other selectable markers include genes that provide resistance to other such herbicides such as glyphosate and the like, and imidazolinones, sulfonylureas, triazolopyrimidine herbicides, such as chlorosulfron, bromoxynil, dalapon, and the like. Furthermore, genes encoding dihydrofolate reductase may be used in combination with molecules such as methatrexate.

Efficient use of selectable markers is facilitated by a determination of the susceptibility of a plant cell to a particular selectable agent and a determination of the concentration of this agent which effectively kills most, if not all, of the transformed cells. Some useful concentrations of antibiotics for tobacco transformation include, for example, 20-100 µg/ml (kanamycin), 20-50 µg/ml (hygromycin), or 5-10 µg/ml (bleomycin). A useful strategy for selection of transformants for herbicide resistance is described, for example, by Vasil (*Cell Culture and Somatic Cell Genetics of Plants*, Vol I, II, III Laboratory Procedures and Their Applications, Academic Press, New York, 1984).

In addition to a selectable marker, it may be desirable to use a reporter gene. In some instances a reporter gene may be used without a selectable marker. Reporter genes are genes which are typically not present or expressed in the recipient organism or tissue. The reporter gene typically encodes for a protein which provide for some phenotypic change or enzymatic property. Examples of such genes are provided in Weising et al. (*Ann. Rev. Genetics* 22:421, 1988), which is incorporated herein by reference. Preferred reporter genes include without limitation glucuronidase (GUS) gene and GFP genes.

Upon construction of the plant expression vector, several standard methods are available for introduction of the vector into a plant host, thereby generating a transgenic plant. These methods include (1) *Agrobacterium*-mediated transformation (*A. tumefaciens* or *A. rhizogenes*) (see, for example, Lichtenstein and Fuller In: *Genetic Engineering*, vol 6, P W J Rigby, ed, London, Academic Press, 1987; and Lichtenstein, C. P., and Draper, J., In: *DNA Cloning*, Vol II, D. M. Glover, ed, Oxford, IRI Press, 1985; U.S. Pat. Nos. 4,693,976, 4,762,785, 4,940,838, 5,004,863, 5,104,310, 5,149,645, 5,159,135, 5,177,010, 5,231,019, 5,463,174, 5,469,976, and 5,464,763; and European Patent Numbers 0131624, 0159418, 0120516, 0176112, 0116718, 0290799, 0292435, 0320500, and 0627752, and European Patent Application Numbers 0267159 and 0604622,), (2) the particle delivery system (see, for example, U.S. Pat. Nos. 4,945,050 and 5,141,131), (3) microinjection protocols, (4) polyethylene glycol (PEG) procedures, (5) liposome-mediated DNA uptake, (6) electroporation protocols (see, for example, WO 87/06614 and U.S. Pat. Nos. 5,384,253, 5,472,869, 5,641,664, 5,679,558, 5,712,135, 6,002,070, and 6,074,877, (7) the vortexing method, or (8) the so-called whiskers methodology (see, for example, Coffee et al., U.S. Pat. Nos. 5,302,523 and 5,464,765). The type of plant tissue that may be transformed with an expression vector includes embryonic tissue, callus tissue type I and II, hypocotyls, meristem, and the like.

Once introduced into the plant tissue, the expression of the structural gene may be assayed by any means known to the art, and expression may be measured as mRNA transcribed, protein synthesized, or the amount of gene silencing that occurs as determined by metabolite monitoring via chemical analysis of secondary alkaloids in tobacco (as described herein; see also U.S. Pat. No. 5,583,021 which is hereby incorporated by reference). Techniques are known for the in vitro culture of plant tissue, and in a number of cases, for regeneration into whole plants (see, e.g., U.S. Pat. Nos. 5,595,733 and 5,766,900). Procedures for transferring the introduced expression complex to commercially useful cultivars are known to those skilled in the art.

Once plant cells expressing the desired level of a desirable gene product are obtained, plant tissues and whole plants can be regenerated therefrom using methods and techniques well-known in the art. The regenerated plants are then reproduced by conventional means and the introduced genes can be transferred to other strains and cultivars by conventional plant breeding techniques.

Transgenic tobacco plants may incorporate a nucleic acid of any portion of the genomic gene in different orientations for either down-regulation, for example, antisense orientation, or over-expression, for example, sense orientation. Over-expression of the nucleic acid sequence that encodes the entire or a functional part of an amino acid sequence of a full-length tobacco gene is desirable for increasing the expression of the gene product within *Nicotiana* lines.

Determination of Transcriptional or Translational Levels of a Tobacco Gene

Gene expression may be measured, for example, by standard Northern blot analysis (Ausubel et al., *Current Protocols in Molecular Biology*, John Wiley & Sons, New York, N.Y., (2001), and Sambrook et al., *Molecular Cloning: A Laboratory Manual*, Cold Spring Harbor Laboratory, N.Y., (1989)) using a tobacco gene or gene fragment as a hybridization probe. Determination of RNA expression levels may also be aided by reverse transcription PCR (rtPCR), including quantitative rtPCR (see, e.g., Kawasaki et al., in PCR Technology: Principles and Applications of DNA Amplification (H. A. Erlich, Ed.) Stockton Press (1989); Wang et al. in PCR Protocols: A Guide to Methods and Applications (M. A. Innis, et al., Eds.) Academic Press (1990); and Freeman et al., *Biotechniques* 26:112-122 and 124-125, 1999). Additional well-known techniques for determining expression of a tobacco gene include in situ hybridization, and fluorescent in situ hybridization (see, e.g., Ausubel et al., *Current Protocols in Molecular Biology*, John Wiley & Sons, New York, N.Y., (2001)). The above standard techniques are also useful to compare the expression level between plants, for example, between a plant having a mutation in a tobacco gene and a control plant.

If desired, expression of a tobacco gene (e.g., a nucleic acid sequence shown in FIGS. 1, 3 to 7, 10 to 158, 162 to 170, 172-1 to 172-19, and 173-1 to 173-294, or a fragment thereof) may be measured at the level of protein production using the same general approach and standard protein analysis techniques including Bradford assays, spectrophotometric assays, and immunological detection techniques, such as Western blotting or immunoprecipitation with an antibody specific for the desirable polypeptide (Ausubel et al., *Current Protocols in Molecular Biology*, John Wiley & Sons, New York, N.Y., (2001), and Sambrook et al., *Molecular Cloning: A Laboratory Manual*, Cold Spring Harbor Laboratory, N.Y., (1989)).

The activity of any polypeptide described herein may be assayed using standard methods in the art. For example, the activity of a p450 is typically assayed using fluorescent-based assays (see, e.g., Donato et al. *Drug Metab Dispos.* 32: 699-706, 2004). In particular, the activity of a nicotine demethylase may be assayed as described herein using yeast microsome assays.

Identification of Modulators of a Tobacco Gene Product

Isolation of a cDNA also facilitates the identification of molecules that increase or decrease expression the gene product. According to one approach, candidate molecules are added at varying concentrations to a culture medium of cells (for example, prokaryotic cells such as *E. coli* or eukaryotic cells such as yeast, mammalian, insect, or plant cells) expressing a tobacco mRNA. Gene product expression is then measured in the presence and absence of a candidate molecule using standard methods such as those set forth herein.

Candidate modulators may be purified (or substantially purified) molecules or may be one component of a mixture of compounds. In a mixed compound assay, gene product expression is tested against progressively smaller subsets of the candidate compound pool (for example, produced by standard purification techniques, for example, HPLC) until a single compound or minimal compound mixture is demonstrated to alter tobacco nicotine demethylase gene expression. In one embodiment of the invention, a molecule that promotes a decrease gene product expression is considered particularly desirable. Modulators found to be effective at the level of gene product expression or activity may be confirmed as useful in planta.

For agricultural uses, the molecules, compounds, or agents identified using the methods disclosed herein may be used as chemicals applied as sprays or dusts on the foliage of plants. The molecules, compounds, or agents may also be applied to plants in combination with another molecule which affords some benefit to the plant.

Uses

Regulation of the endogenous gene corresponding to any of the sequences described herein by, for example, gene silencing may result in more valuable plants or plant products. In particular, sequences identified herein as ethylene-induced or senescence-related (e.g., those having the sequence of SEQ ID NOS:4, 40, 44, 52, 54, 60, 70, 104, 138, 140, 158, 162, 188, 212, 226, 234, and 288 or a nucleic acid sequence shown in FIGS. 2 to 7 and SEQ ID NOS: 446 to 2193, or a fragment thereof) may be used to affect metabolic pathways involved in the formation of numerous secondary metabolites including terpenoids, polyphenols, alkaloids, etc. that affect end-product quality traits. Similarly, the genes identified herein may be used to regulate metabolic pathways associated with the rate and type of dry matter accumulated during senescence or the partitioning of dry matter within the plant during senescence. Regulating the genes identified herein may also be used to affect metabolic pathways involved in determining senescence rates, the uniformity of senescence within a leaf and among leaves of a single plant, and the induction of senescence by agents or activities that stimulate or activate the genes identified herein, and, thereby, control the quality of a product or article of manufacture that includes a leaf or other plant component.

The promoter region of a gene described herein may be used to drive expression of any desirable gene product to improve crop quality or enhance specific traits. A promoter that is inducible and expressed during a particular period of the plant's life cycle can be used in constructs for introduction into the plant to express unique genes involved in the biosynthesis of flavor and aroma products that result from secondary metabolites. A tobacco gene promoter may also be used to increase or modify the expression of structural carbohydrates or proteins that affect end-use properties. Further, a tobacco gene promoter could be combined with heterologous genes that include genes involved in the biosynthesis of nutritional products, pharmaceutical agents, or industrial materials. Regulation of a promoter sequence may also be used to down-regulate endogenous tobacco genes, including genes involved in alkaloid biosynthesis and/or in other pathways. Desirably, a tobacco gene promoter region or other transcriptional regulatory region is used to alter chemical properties such as nornicotine content and nitrosamine levels in a plant. In addition, promoter motifs, which can readily be identified in a promoter sequence using standard methods in the art, may be used to identify factors that associate with or regulate the expression of a tobacco gene product, e.g., a p450.

Moreover, any of the sequences of the present invention (e.g., the nucleic acid sequences shown in FIG. 2 to 7 and SEQ ID NOS: 446 to 2193, or fragments thereof) may be used in methods that reduce gene expression or alter enzymatic activity of a gene product, such as a p450, using standard techniques described herein. Such techniques include, without limitation, RNA interference, triple strand interference, ribozymes, homologous recombination, virus-induced gene silencing, antisense and co-suppression technologies, expression of a dominant negative gene product, and the generation of mutated genes using standard mutagenesis techniques. For example, reducing p450 expression or altering p450 enzymatic activity may be used to alter fatty acids that are involved in plant-pathogen interactions and disease resistance or may be used to alter a plant's profile of selected fatty acids and thereby alter the flavor or aroma of the plant or plant component.

Furthermore, using standard methods, any portion of a tobacco gene, including the promoter, the coding sequence, an intron, or a 3'UTR, or a fragment thereof, can be used as a genetic marker to isolate related genes, promoters or regulatory regions, for screening for the related gene in other tobacco or *Nicotiana* species, or for determining whether a plant has a mutation in a corresponding endogenous gene. A portion of a tobacco gene may also be used to monitor gene flow through a breeding effort to track intergression or loss of a particular gene.

For example, *Nicotiana tabacum* is an allotetraploid, as are several of the other *Nicotiana* species, and the genetic markers could be used to identify homologous genes or related genes in the parental genome different from the genome in which the original gene resides. A marker for the related gene could be also be used to screen existing tobacco germplasm, segregating or synthetic populations created by hybridizations, populations created from mutagenic treatments or from various tissue culture methods. As such, the nucleic acid sequences described herein (e.g., the nucleic acid sequences shown in FIGS. 2 to 7 and SEQ ID NOS: 446 to 2193, or fragments thereof) may be used to identify or affect genes involved in disease or insect resistance, flavor and aroma properties, herbicide tolerance, quality factors related to undesirable constituents, or that increase leaf yield, or affect leaf or plant components, such as lignins, cellulose, etc., related to structural traits or fiber content.

Products

Tobacco products having a reduced amount of nitrosamine content are manufactured using any of the tobacco plant material described herein according to standard methods known in the art. In one embodiment, tobacco products are manufactured using tobacco plant material obtained from a cured tobacco plant. The cured tobacco plant may contain or have been bred to contain reduced nicotine demethylase activity. For example, the cured tobacco plant may be a tobacco plant resulting from a cross including a tobacco plant identified as having variant expression of nicotine demethylase. Desirably the tobacco product has a reduced amount of nornicotine or NNN of less than about 5 mg/g, 4.5 mg/g, 4.0 mg/g, 3.5 mg/g, 3.0 mg/g, 2.5 mg/g, 2.0 mg/g, 1.5 mg/g, 1.0 mg/g, 750 µg/g, 500 µg/g, 250 µg/g, 100 µg/g, 75 µg/g, 50 µg/g, 25 µg/g, 10 µg/g, 7.0 µg/g, 5.0 µg/g, 4.0 µg/g, 2.0 µg/g, 1.0 µg/g, 0.5 µg/g, 0.4 µg/g, 0.2 µg/g, 0.1 µg/g, 0.05 µg/g, or 0.01 µg/g or wherein the percentage of secondary alkaloids relative to total alkaloid content contained therein is less than 90%, 70%, 50%, 30%, 10%, 5%, 4%, 3%, 2%, 1.5%, 1%, 0.75%, 0.5%, 0.25%, or 0.1%. The phrase "a reduced amount" refers to an amount of nornicotine or NNN or both in a tobacco plant or plant component or a tobacco product that is less than what would be found in a wild-type tobacco plant or plant component or tobacco product from the same variety of tobacco, processed in the same manner, which was not made transgenic for reduced nornicotine or NNN. In one example, a wild-type tobacco plant of the same variety that has been processed in the same manner is used as a control to measure whether a reduction of nornicotine or NNN or both has been obtained by the methods described herein. In another example, plants having a reduced amount of nitrosamine content are evaluated using standard methods, for instance, by monitoring the presence or absence of a gene or gene product, e.g., a nicotine demethylase, or a particular mutation in a gene. In still another example, nitrosamine content of plants resulting from a breeding program are compared to the nitrosamine content of the recipient line or donor line, or both, used to breed the plant having the reduced amount of nitrosamine. Other suitable controls known in the art are also used as needed. Levels of nornicotine and NNN or both are measured according to methods well known in the tobacco art.

The following examples illustrate methods for carrying out the invention and should be understood to be illustrative of, but not limiting upon, the scope of the invention which is defined in the appended claims.

EXAMPLE 1

Development of Plant Tissue and Ethylene Treatment

Plant Growth

Plants were seeded in pots and grown in a greenhouse for 4 weeks. The 4-week old seedlings were transplanted into individual pots and grown in the greenhouse for 2 months. The plants were watered 2 times a day with water containing 150 ppm NPK fertilizer during growth.

The expanded green leaves were detached from plants to do the ethylene treatment described below.

Cell Line 78379

Tobacco line 78379, which is a Burley tobacco line released by the University of Kentucky was used as a source of plant material. One hundred plants were cultured as standard in the art of growing tobacco, transplanted, and tagged with a distinctive number (1-100). Fertilization and field management were conducted as recommended.

Three quarters of the 100 plants converted between 20 and 100% of the nicotine to nornicotine. One quarter of the 100 plants converted less than 5% of the nicotine to nornicotine. Plant number 87 had the least conversion (2%) while plant number 21 had 100% conversion. Plants converting less than 3% were classified as non-converters. Self-pollinated seed of plant number 87 and plant number 21, as well as crossed (21×87 and 87×21) seeds were made to study genetic and phenotypic differences. Plants from selfed 21 were converters, and 99% of selfs from 87 were non-converters. The other 1% of the plants from 87 showed low conversion (5-15%). Plants from reciprocal crosses were all converters.

Cell Line 4407

*Nicotiana* line 4407, which is a Burley line, was used as a source of plant material. Uniform and representative plants (100) were selected and tagged. Of the 100 plants 97 were non-converters and three were converters. Plant number 56 had the least amount of conversion (1.2%) and plant number 58 had the highest level of conversion (96%). Self-pollinated seeds and crossed seeds were made with these two plants.

Plants from selfed-58 segregated with 3:1 converter to non-converter ratio. Plants 58-33 and 58-25 were identified as homozygous converter and nonconverter plant lines, respectively. The stable conversion of 58-33 was confirmed by analysis of its progeny.

Cell Line PBLB01

PBLB01 is a Burley line developed by ProfiGen, Inc. and was used as a source of plant material. The converter plant was selected from foundation seeds of PBLB01.

Ethylene Treatment Procedures

Green leaves were detached from 2-3 month greenhouse grown plants and sprayed with 0.3% ethylene solution (Prep brand Ethephon (Rhone-Poulenc)). Each sprayed leaf was hung in a curing rack equipped with humidifier and covered with plastic. During the treatment, the sample leaves were periodically sprayed with the ethylene solution. Approximately 24-48 hour post ethylene treatment, leaves were collected for RNA extraction. Another sub-sample was taken for metabolic constituent analysis to determine the concentration of leaf metabolites and more specific constituents of interest such as a variety of alkaloids.

As an example, alkaloids analysis could be performed as follows. Samples (0.1 g) were shaken at 150 rpm with 0.5 ml 2N NaOH, and a 5 ml extraction solution which contained quinoline as an internal standard and methyl t-butyl ether. Samples were analyzed on a HP 6890 GC equipped with a FID detector. A temperature of 250° C. was used for the detector and injector. An HP column (30 m-0.32 nm-1 mm) consisting of fused silica crosslinked with 5% phenol and 95% methyl silicon was used at a temperature gradient of 110-185° C. at 10° C. per minute. The column was operated at 100° C. with a flow rate of 1.7 $cm^3 min^{-1}$ with a split ratio of 40:1 with a 2:1 injection volume using helium as the carrier gas.

EXAMPLE 2

RNA Isolation

For RNA extractions, middle leaves from two-month old greenhouse grown plants were treated with ethylene as described above. The 0 and 24-48 hours samples were used for RNA extraction. In some cases, leaf samples under the senescence process were taken from the plants 10 days post flower-head removal. These samples were also used for extraction. Total RNA was isolated using Rneasy Plant Mini Kit® (Qiagen, Inc., Valencia, Calif.) according to the manufacturer's protocol.

The tissue sample was ground under liquid nitrogen to a fine powder using a DEPC treated mortar and pestle. Approximately 100 milligrams of ground tissue were transferred to a sterile 1.5 ml Eppendorf tube. This sample tube was placed in liquid nitrogen until all samples were collected. Then, 450 μl of Buffer RLT as provided in the kit (with the addition of Mercaptoethanol) was added to each individual tube. The sample was vortexed vigorously and incubated at 56° C. for 3 minutes. The lysate was then applied to the QIAshredder® spin column sitting in a 2 ml collection tube, and centrifuged for 2 minutes at maximum speed. The flow through was collected and 0.5 volume of ethanol was added to the cleared lysate. The sample was mixed well and transferred to an Rneasy® mini spin column sitting in a 2 ml collection tube. The sample was centrifuged for 1 minute at 10,000 rpm. Next, 700 μl of buffer RW1 was pipetted onto the Rneasy® column and centrifuged for 1 minute at 10,000 rpm. Buffer RPE was pipetted onto the Rneasy® column in a new collection tube and centrifuged for 1 minute at 10,000 rpm. Buffer RPE was again, added to the Rneasy® spin column and centrifuged for 2 minutes at maximum speed to dry the membrane. To eliminate any ethanol carry over, the membrane was placed in a separate collection tube and centrifuged for an additional 1 minute at maximum speed. The Rneasy® column was transferred into a new 1.5 ml collection tube, and 40 μl of Rnase-free water was pipetted directly onto the Rneasy® membrane. This final elute tube was centrifuged for 1 minute at 10,000 rpm. Quality and quantity of total RNA was analyzed by denatured formaldehyde gel and spectrophotometer.

Poly(A)RNA was isolated using Oligotex® poly A+ RNA purification kit (Qiagen Inc.) following the manufacturer's protocol. About 200 μg total RNA in 250 μl maximum volume was used. A volume of 250 μl of Buffer OBB and 15 μl of Oligotex® suspension was added to the 250 μl of total RNA. The contents were mixed thoroughly by pipetting and incubated for 3 minutes at 70° C. on a heating block. The sample was then placed at room temperature for approximately 20 minutes. The Oligotex®: mRNA complex was pelleted by centrifugation for 2 minutes at maximum speed. All but 50 μl of the supernatant was removed from the microcentrifuge tube. The sample was treated further by OBB buffer. The Oligotex®: mRNA pellet was resuspended in 400 μl of Buffer OW2 by vortexing. This mix was transferred onto a small spin column placed in a new tube and centrifuged for 1 minute at maximum speed. The spin column was transferred to a new tube and an additional 400 μl of Buffer OW2 was added to the column. The tube was then centrifuged for 1 minute at maximum speed. The spin column was transferred to a final 1.5 ml microcentrifuge tube. The sample was eluted with 60 μl of hot (70° C.) Buffer OEB. Poly A product was analyzed by denatured formaldehyde gels and spectrophotometric analysis.

EXAMPLE 3

Reverse-Transcription-PCR

First strand cDNA was produced using SuperScript reverse transcriptase following the manufacturer's protocol (Invitrogen, Carlsbad, Calif.). The poly A+ enriched RNA/oligo dT primer mix consisted of less than 5 μg of total RNA, 1 μl of 10 mM dNTP mix, 1 μl of Oligo $d(T)_{12-18}$ (0.5 μg/μl), and up to 10 μl of DEPC-treated water. Each sample was incubated at 65° C. for 5 minutes, then placed on ice for at least 1 minute. A reaction mixture was prepared by adding each of the following components in order: 2 μl 10× RT buffer, 4 μl of 25 mM $MgCl_2$, 2 μl of 0.1 M DTT, and 1 μl of RNase OUT Recombinant RNase Inhibitor. An addition of 9 μl of reaction mixture was pipetted to each RNA/primer mixture and gently mixed. It was incubated at 42° C. for 2 minutes and 1 μl of Super Script II RT was added to each tube. The tube was incubated for 50 minutes at 42° C. The reaction was terminated at 70° C. for 15 minutes and chilled on ice. The sample was collected by centrifugation and 1 μl of RNase H was added to each tube and incubated for 20 minutes at 37° C. The second PCR was carried out with 200 pmoles of forward primer and 100 pmoles reverse primer (mix of 18 nt oligo d(T) followed by 1 random base).

Reaction conditions were 94° C. for 2 minutes and then 40 cycles of PCR at 94° C. for 1 minute, 45° C. to 60° C. for 2 minutes, 72° C. for 3 minutes, with a 72° C. extension for an extra 10 min. Ten microliters of the amplified sample were analyzed by electrophoresis using a 1% agarose gel. The correct size fragments were purified from agarose gel.

EXAMPLE 4

Generation of PCR Fragment Populations

PCR fragments from Example 3 were ligated into a pGEM-T Easy Vector (Promega, Madison, Wis.) following the manufacturer's instructions. The ligated product was transformed into JM109 competent cells and plated on LB media plates for blue/white selection. Colonies were selected and grown in a 96 well plate with 1.2 ml of LB media overnight at 37° C. Frozen stock was generated for all selected colonies. Plasmid DNA was purified from plates using Beckman's Biomeck 2000 miniprep robotics with Wizard SV Miniprep kit (Promega). Plasmid DNA was eluted with 100 μl water and stored in a 96 well plate. Plasmids were digested by EcoR1 and were analyzed using 1% agarose gel to confirm the DNA quantity and size of inserts. Plasmids containing a 400-600 bp insert were sequenced using a CEQ 2000 sequencer (Beckman, Fullerton, Calif.). The sequences were aligned with GenBank database by BLAST search (see, e.g., FIGS. 159A to 159K). The p450 related fragments were identified and further analyzed. Alternatively, p450 fragments were isolated from subtraction libraries. These fragments were also analyzed as described above.

EXAMPLE 5 cDNA Library Construction

A cDNA library was constructed by preparing total RNA from ethylene treated leaves as follows. First, total RNA was extracted from ethylene treated leaves of tobacco line 58-33 using a modified acid phenol and chloroform extraction protocol. The protocol was modified to use one gram of tissue that was ground and subsequently vortexed in 5 ml of extraction buffer (100 mM Tris-HCl, pH 8.5; 200 mM NaCl; 10 mM EDTA; 0.5% SDS) to which 5 ml phenol (pH 5.5) and 5 ml chloroform was added. The extracted sample was centrifuged and the supernatant was saved. This extraction step was repeated 2-3 times until the supernatant appeared clear. Approximately 5 ml of chloroform was added to remove trace amounts of phenol. RNA was precipitated from the combined supernatant fractions by adding a 3-fold volume of ethanol and $\frac{1}{10}$ volume of 3M NaOAc (pH 5.2) and storing at −20° C. for 1 hour. After transfer to a Corex glass container the RNA fraction was centrifuged at 9,000 RPM for 45 minutes at 4° C. The pellet was washed with 70% ethanol and spun for 5 minutes at 9,000 RPM at 4° C. After drying the pellet, the pelleted RNA was dissolved in 0.5 ml RNase free water. The quality and quantity of total RNA was analyzed by denatured formaldehyde gel and spectrophotometer, respectively.

The resultant total RNA was used to isolate poly A+ RNA using an Oligo(dT) cellulose protocol (Invitrogen) and microcentrifuge spin columns (Invitrogen) by the following protocol. Approximately twenty mg of total RNA was twice subjected to purification to obtain high quality poly A+ RNA. Poly A+ RNA product was analyzed by performing denatured formaldehyde gel and subsequent RT-PCR of known full-length genes to ensure high quality of mRNA.

Next, poly A+ RNA was used as template to produce a cDNA library employing cDNA synthesis kit, ZAP-cDNA synthesis kit, and ZAP-cDNA Gigapack III gold cloning kit (Stratagene, La Jolla, Calif.). The method involved following the manufacturer's protocol as specified. Approximately 8 μg of poly A+ RNA was used to construct cDNA library. Analysis of the primary library revealed about $2.5 \times 10^6$-$1 \times 10^7$ pfu. A quality background test of the library was completed by complementation assays using IPTG and X-gal, where recombinant plaques was expressed at more than 100-fold above the background reaction.

A more quantitative analysis of the library by random PCR showed that average size of insert cDNA was approximately 1.2 kb. The method used a two-step PCR method. For the first step, reverse primers were designed based on the preliminary sequence information obtained from p450 fragments. The designed reverse primers and T3 (forward) primers were used to amplify corresponding genes from the cDNA library. PCR reactions were subjected to agarose electrophoresis and the corresponding bands of high molecular weight were excised, purified, cloned and sequenced. In the second step, new primers designed from 5'UTR or the start coding region of p450 as the forward primers together with the reverse primers (designed from 3'UTR of p450) were used in the subsequent PCR to obtain full-length p450 clones.

The p450 fragments were generated by PCR amplification from the constructed cDNA library as described in Example 3 with the exception of the reverse primer. The T7 primer located on the plasmid downstream of cDNA inserts was used as a reverse primer. PCR fragments were isolated, cloned and sequenced as described in Example 4.

Full-length p450 genes were isolated by this PCR method from constructed cDNA library. Gene specific reverse primers (designed from the downstream sequence of p450 fragments) and a forward primer (T3 on library plasmid) were used to clone the full-length genes. PCR fragments were isolated, cloned and sequenced. If necessary, a second PCR step was applied. In the second step, new forward primers designed from 5'UTR of cloned p450s together with the reverse primers designed from 3'UTR of p450 clones were used in the subsequent PCR reactions to obtain full-length p450 clones. The clones were subsequently sequenced.

EXAMPLE 6

Characterization of Cloned Fragments—Reverse Southern Blotting Analysis

Nonradioactive large-scale reverse Southern blotting assays were performed on all p450 clones identified in above examples to detect the differential expression. It was observed that the level of expression among different p450 clusters was very different. Further real time detection was conducted on those with high expression.

Nonradioactive Southern blotting procedures were conducted as follows.

1) Total RNA was extracted from ethylene treated and nontreated converter (58-33) and nonconverter (58-25) leaves using the Qiagen Rnaeasy kit as described in Example 2.

2) A probe was produced by biotin-tail labeling a single strand cDNA derived from poly A+ enriched RNA generated in above step. This labeled single strand cDNA was generated by RT-PCR of the converter and nonconverter total RNA (Invitrogen) as described in Example 3 with the exception of using biotinylated oligo dT as a primer (Promega). These were used as a probe to hybridize with cloned DNA.

3) Plasmid DNA was digested with restriction enzyme EcoR1 and run on agarose gels. Gels were simultaneously dried and transferred to two nylon membranes (Biodyne B). One membrane was hybridized with converter probe and the other with nonconverter probe. Membranes were UV-crosslinked (auto crosslink setting, 254 nm, Stratagene, Stratalinker) before hybridization.

Alternatively, the inserts were PCR amplified from each plasmid using the sequences located on both arms of p-GEM plasmid, T3 and SP6, as primers. The PCR products were analyzed by running on a 96 well Ready-to-run agarose gels. The confirmed inserts were dotted on two nylon membranes. One membrane was hybridized with converter probe and the other with nonconverter probe.

4) The membranes were hybridized and washed following the manufacturer's instructions with the modification of washing stringency (Enzo MaxSence kit, Enzo Diagnostics, Inc, Farmingdale, N.Y.). The membranes were prehybridized with hybridization buffer (2×SSC buffered formamide, containing detergent and hybridization enhancers) at 42° C. for 30 min and hybridized with 10 μl denatured probe overnight at 42° C. The membranes then were washed in 1× hybridization wash buffer 1 time at room temperature for 10 min and 4 times at 68° C. for 15 min. The membranes were ready for the detection procedure.

5) The washed membranes were detected by alkaline phosphatase labeling followed by NBT/BCIP colometric detection as described in manufacturer's detection procedure (Enzo Diagnostics, Inc.). The membranes were blocked for one hour at room temperature with 1× blocking solution, washed 3 times with 1× detection reagents for 10 min, washed 2 times with 1× predevelopment reaction buffer for 5 min and then developed the blots in developing solution for 30-45 min until the dots appear. All reagents were provided by the manufacturer (Enzo Diagnostics, Inc). In addition, large-scale reverse Southern assay was also performed using KPL Southern hybridization and detection kit following the manufacturer's instructions (KPL, Gaithersburg, Md.).

EXAMPLE 7

Characterization of Clones—Northern Blot Analysis

As an alternative to Southern blot analysis, some membranes were hybridized and detected as described in the example of Northern blotting assays. Northern hybridization was used to detect mRNA differentially expressed in *Nicotiana* as follows.

A random priming method was used to prepare probes from cloned p450 (Megaprime DNA Labelling Systems, Amersham Biosciences). The following components were mixed: 25 ng denatured DNA template; 4 ul of each unlabeled dTTP, dGTP and dCTP; 5 ul of reaction buffer; $P^{32}$-labelled dATP and 2 ul of Klenow I; and $H_2O$, to bring the reaction to 50 μl. The mixture was incubated in 37° C. for 1-4 hours, and stopped with 2 μl of 0.5 M EDTA. The probe was denatured by incubation at 95° C. for 5 minutes before use.

RNA samples were prepared from ethylene treated and non-treated fresh leaves of several pairs of tobacco lines. In some cases poly A+ enriched RNA was used. Approximately 15 μg total RNA or 1.8 μg mRNA (methods of RNA and mRNA extraction as described in Example 5) were brought to equal volume with DEPC $H_2O$ (5-10 μl). The same volume of loading buffer (1× MOPS; 18.5% Formaldehyde; 50% Formamide; 4% Ficoll 400; Bromophenolblue) and 0.5 μl EtBr (0.5 μg/μl) were added. The samples were subsequently denatured in preparation for separation of the RNA by electrophoresis.

Samples were subjected to electrophoresis on a formaldehyde gel (1% Agarose, 1× MOPS, 0.6 M Formaldehyde) with 1× MOP buffer (0.4 M Morpholinopropanesulfonic acid; 0.1 M Na-acetate-3× H2O; 10 mM EDTA; adjust to pH 7.2 with NaOH). RNA was transferred to a Hybond-N+ membrane (Nylon, Amersham Pharmacia Biotech) by capillary method in 10×SSC buffer (1.5 M NaCl; 0.15 M Na-citrate) for 24 hours. Membranes with RNA samples were UV-crosslinked (auto crosslink setting, 254 nm, Stratagene, Stratalinker) before hybridization.

The membrane was prehybridized for 1-4 hours at 42° C. with 5-10 ml prehybridization buffer (5×SSC; 50% Formamide; 5× Denhardt's-solution; 1% SDS; 100 μg/ml heat-denatured sheared non-homologous DNA). Old prehybridization buffer was discarded, and new prehybridization buffer and probe were added. The hybridization was carried out overnight at 42° C. The membrane was washed for 15 minutes with 2×SSC at room temperature, followed by a wash with 2×SSC.

As illustrated in Table 1 below, Northern blots and reverse Southern Blot were useful in determining which genes were induced by ethylene treatment relative to non-induced plants. Interestingly, not all fragments were affected similarly in the converter and nonconverter. Some of the cytochrome p450 fragments were partially sequenced to determine their structural relatedness. This information was used to subsequently isolate and characterize full-length gene clones of interest.

TABLE 1

The Effect of Ethylene Treatment on mRNA Induction

| Fragments | Induced mRNA Expression Ethylene Treatment Converter |
|---|---|
| D56-AC7 (SEQ ID No: 44) | + |
| D56-AG11 (SEQ ID No: 40) | + |
| D56-AC12 (SEQ ID No: 54) | + |
| D70A-AB5 (SEQ ID No: 104) | + |
| D73-AC9 (SEQ ID No: 52) | + |
| D70A-AA12 (SEQ ID No: 140) | + |
| D73A-AG3 (SEQ ID No: 138) | + |
| D34-52 (SEQ ID No: 70) | + |
| D56-AG6 (SEQ ID No: 60) | + |

Northern analysis was performed using full-length clones on tobacco tissue obtained from converter and nonconverter Burley lines that were induced by ethylene treatment. This analysis was used to identify full-length clones that showed elevated expression in ethylene induced converter lines relative to ethylene induced converter lines relative to ethylene induced nonconverter Burley lines. By so doing, the functionality relationship of full-length clones may be determined by comparing biochemical differences in leaf constituents between converter and non-converter lines.

As shown in Table 2 below, six clones showed significantly higher expression, as denoted by ++ and +++, in converter ethylene treated tissue in comparison to non-converter treated tissue, denoted by +. All of these clones showed little or no expression in converter and non-converter lines that were not ethylene treated.

TABLE 2

Clones with Elevated Expression in Converter Ethylene-Treated Tissue

| Full-Length Clones | Converter | Nonconverter |
|---|---|---|
| D101-BA2 (SEQ ID NO: 288) | ++ | + |
| D207-AA5 (SEQ ID NO: 212) | ++ | + |
| D208-AC8 (SEQ ID NO: 226) | +++ | + |
| D237-AD1 (SEQ ID NO: 234) | ++ | + |
| D89-AB1 (SEQ ID NO: 158) | ++ | + |
| D90A-BB3 (SEQ ID NO: 162) | ++ | + |

EXAMPLE 8

Immunodetection of Polypeptides Encoded by the Cloned Genes

Peptide regions corresponding to 20-22 amino acids in length from three p450 clones were selected for (1) having lower or no homology to other clones and (2) having good hydrophilicity and antigenicity. The amino acid sequences of the peptide regions selected from the respective p450 clones are listed below. The synthesized peptides were conjugated with KHL (keyhole limpet hemocyanin) and then injected into rabbits. Antisera were collected 2 and 4 weeks after the 4th injection (Alpha Diagnostic Intl. Inc. San Antonio, Tex.).

| D234-AD1 | DIDGSKSKLVKAHRKIDEILG | (SEQ ID NO:2266) |
| D90a-BB3 | RDAFREKETFDENDVEELNY | (SEQ ID NO:163) |
| D89-AB1 | FKNNGDEDRHFSQKLGDLADKY | (SEQ ID NO:2267) |

Antisera were examined for crossreactivity to target proteins from tobacco plant tissue by Western Blot analysis. Crude protein extracts were obtained from ethylene treated (0 to 40 hours) middle leaves of converter and nonconverter lines. Protein concentrations of the extracts were determined using RC DC Protein Assay Kit (BIO-RAD) following the manufacturer's protocol.

Two micrograms of protein were loaded onto each lane and the proteins were separated on 10% -20% gradient gels using the Laemmli SDS-PAGE system. The proteins were transferred from gels to PROTRAN Nitrocellulose Transfer Membranes (Schleicher & Schuell) with the Trans-Blot Semi-Dry cell (BIO-RAD). Target p450 proteins were detected and visualized with the ECL Advance Western Blotting Detection Kit (Amersham Biosciences). Primary antibodies against the synthetic-KLH conjugates were made in rabbits. Secondary antibody against rabbit IgG, coupled with peroxidase, was purchased from Sigma. Both primary and secondary antibodies were used at 1:1000 dilutions. Antibodies showed strong reactivity to a single band on the Western Blots indicating that the antisera were monospecific to the target peptide of interest. Antisera were also crossreactive with synthetic peptides conjugated to KLH.

EXAMPLE 9

Nucleic Acid Identity, Structure Relatedness of Isolated Nucleic Acid Fragments, and GeneChip® Hybridization Over 100 cloned p450 fragments were sequenced in conjunction with Northern blot analysis to determine their structural relatedness. The approach used forward primers based either of two common p450 motifs located near the carboxyl-terminus of the p450 genes. The forward primers corresponded to cytochrome p450 motifs FXPERF (SEQ ID NO:2268) or GRRXCP(A/G) (SEQ ID NO:2269). The reverse primers used standard primers from either the plasmid, SP6 or T7 located on both arms of pGEM plasmid, or a poly A tail. The protocol used is described below.

Spectrophotometry was used to estimate the concentration of starting double-stranded DNA following the manufacturer's protocol (Beckman Coulter). The template was diluted with water to the appropriate concentration, denatured by heating at 95° C. for 2 minutes, and subsequently placed on ice. The sequencing reaction was prepared on ice using 0.5 to 10 µl of denatured DNA template, 2 µl of 1.6 pmole of the forward primer, 8 µl of DTCS Quick Start Master Mix and the total volume brought to 20 µl with water. The thermocycling program consisted of 30 cycles of the follow cycle: 96° C. for 20 seconds, 50° C. for 20 seconds, and 60° C. for 4 minutes followed by holding at 4° C.

The sequencing reaction was stopped by adding 5 µl of stop buffer (equal volume of 3M NaOAc and 100 mM EDTA and 1 µl of 20 mg/ml glycogen). The sample was precipitated with 60 µl of cold 95% ethanol and centrifuged at 6000×g for 6 minutes. Ethanol was discarded. The pellet was washed twice with 200 µl of cold 70% ethanol. After the pellet was dry, 40 µl of SLS solution were added and the pellet was resuspended. A layer of mineral oil was overlaid and the sample was placed on the CEQ 8000 Automated Sequencer for further analysis.

To verify nucleic acid sequences, the nucleic acid sequence was re-sequenced in both directions using forward primers to the FXPERF (SEQ ID NO:2268) or GRRXCP(A/G)(SEQ ID NO:2269) region of the p450 gene or reverse primers to either the plasmid or poly A tail. All sequencing was performed at least twice in both directions.

The nucleic acid sequences of cytochrome p450 fragments were compared to each other from the coding region corresponding to the first nucleic acid after the region encoding the GRRXCP(A/G) (SEQ ID NO:2269) motif through to the stop codon. This region was selected as an indicator of genetic diversity among p450 proteins. A large number of genetically distinct p450 genes, in excess of 70 genes, were observed, similar to that of other plant species. Upon comparison of nucleic acid sequences, it was found that the genes could be placed into distinct sequences groups based on their sequence identity. It was found that the best unique grouping of p450 members was determined to be those sequences with 75% nucleic acid identity or greater. (See e.g., Table 1 of the US 2004/0162420 patent application publication, which is incorporated herein by reference.) Reducing the percentage identity resulted in significantly larger groups. A preferred grouping was observed for those sequences with 81% nucleic acid identity or greater, a more preferred grouping 91% nucleic acid identity or greater, and a most preferred grouping for those sequences 99% nucleic acid identity of greater. Most of the groups contained at least two members and frequently three or more members. Others were not repeatedly discovered suggesting that approach taken was able to isolated both low and high expressing mRNA in the tissue used.

Based on 75% nucleic acid identity or greater, two cytochrome p450 groups were found to contain nucleic acid sequence identity to previously tobacco cytochrome genes that are genetically distinct from those within the group. Group 23, showed nucleic acid identity, within the parameters used for Table 3A, to GenBank sequences GI:1171579 (SEQ ID NO:2270) (CAA64635) and GI:14423327 (SEQ ID NO:2271) (or AAK62346). GI:1171579 (SEQ ID NO:2270) had nucleic acid identity to Group 23 members ranging 96.9% to 99.5% identity to members of Group 23 while GI:14423327 (SEQ ID NO:2271) ranged 95.4% to 96.9% identity to this group. The members of Group 31 had nucleic acid identity ranging from 76.7% to 97.8% identity to the GenBank reported sequence of GI:14423319 (SEQ ID NO:2272) (AAK62342). None of the other p450 identity groups of Table 3A contained parameter identity, as used in Table 3A, to previously reported *Nicotiana* p450s genes.

A consensus sequence with appropriate nucleic acid degenerate probes could be derived for a group to preferentially identify and isolate additional members of each group from *Nicotiana* plants.

TABLE 3A

*Nicotiana* p450 Nucleic Acid Sequence Identity Groups

| GROUP | FRAGMENTS |
| --- | --- |
| 1 | D58-BG7 (SEQ ID NO: 10), D58-AB1 (SEQ ID NO: 12); D58-BE4 (SEQ ID NO: 16) |
| 2 | D56-AH7 (SEQ ID NO: 18); D13a-5 (SEQ ID NO: 20) |
| 3 | D56-AG10 (SEQ ID NO: 22); D35-33 (SEQ ID NO: 24); D34-62 (SEQ ID NO: 26) |
| 4 | D56-AA7 (SEQ ID NO: 28); D56-AE1 (SEQ ID NO: 30); 185-BD3 (SEQ ID NO: 152) |
| 5 | D35-BB7 (SEQ ID NO: 32); D177-BA7 (SEQ ID NO: 34); D56A-AB6 (SEQ ID NO: 36); D144-AE2 (SEQ ID NO: 38) |
| 6 | D56-AG11 (SEQ ID NO: 40); D179-AA1 (SEQ ID NO: 42) |
| 7 | D56-AC7 (SEQ ID NO: 44); D144-AD1 (SEQ ID NO: 46) |
| 8 | D144-AB5 (SEQ ID NO: 48) |
| 9 | D181-AB5 (SEQ ID NO: 50); D73-AC9 (SEQ ID NO: 52) |
| 10 | D56-AC12 (SEQ ID NO: 54) |

TABLE 3A-continued

Nicotiana p450 Nucleic Acid Sequence Identity Groups

| GROUP | FRAGMENTS |
|---|---|
| 11 | D58-AB9 (SEQ ID NO: 56); D56-AG9 (SEQ ID NO: 58); D56-AG6 (SEQ ID NO: 60); D35-BG11 (SEQ ID NO: 62); D35-42 (SEQ ID NO: 64); D35-BA3 (SEQ ID NO: 66); D34-57 (SEQ ID NO: 68); D34-52 (SEQ ID NO: 70); D34-25 (SEQ ID NO: 72) |
| 12 | D56-AD10 (SEQ ID NO: 74) |
| 13 | 56-AA11 (SEQ ID NO: 76) |
| 14 | D177-BD5 (SEQ ID NO: 78); D177-BD7 (SEQ ID NO: 92) |
| 15 | D56A-AG10 (SEQ ID NO: 80); D58-BC5 (SEQ ID NO: 82); D58-AD12 (SEQ ID NO: 84) |
| 16 | D56-AC11 (SEQ ID NO: 86); D35-39 (SEQ ID NO: 88); D58-BH4 (SEQ ID NO: 90); D56-AD6 (SEQ ID NO: 96) |
| 17 | D73A-AD6 (SEQ ID NO: 98); D70A-BA11 (SEQ ID NO: 100) |
| 18 | D70A-AB5 (SEQ ID NO: 104); D70A-AA8 (SEQ ID NO: 106) |
| 19 | D70A-AB8 (SEQ ID NO: 108); D70A-BH2 (SEQ ID NO: 110); D70A-AA4 (SEQ ID NO: 112) |
| 20 | D70A-BA1 (SEQ ID NO: 114); D70A-BA9 (SEQ ID NO: 116) |
| 21 | D70A-BD4 (SEQ ID NO: 118) |
| 22 | D181-AC5 (SEQ ID NO: 120); D144-AH1 (SEQ ID NO: 122); D34-65 (SEQ ID NO: 124) |
| 23 | D35-BG2 (SEQ ID NO: 126) |
| 24 | D73A-AH7 (SEQ ID NO: 128) |
| 25 | D58-AA1 (SEQ ID NO: 130); D185-BC1 (SEQ ID NO: 142); D185-BG2 (SEQ ID NO: 144) |
| 26 | D73-AE10 (SEQ ID NO: 132) |
| 27 | D56-AC12 (SEQ ID NO: 134) |
| 28 | D177-BF7 (SEQ ID NO: 136); D185-BE1 (SEQ ID NO: 146); D185-BD2 (SEQ ID NO: 148) |
| 29 | D73A-AG3 (SEQ ID NO: 138) |
| 30 | D70A-AA12 (SEQ ID NO: 140); D176-BF2 (SEQ ID NO: 94) |
| 31 | D176-BC3 (SEQ ID NO: 154) |
| 32 | D176-BB3 (SEQ ID NO: 156) |
| 33 | D186-AH4 (SEQ ID NO: 14) |

GeneChip® microarray hybridization (Affymetrix Inc.; Santa Clara, Calif.) was used to identify genes with differential expression patterns between the converter and nonconverter near isogenic lines following ethylene activation. The chip size was 18 micron and the array format was 100-2187, accommodating 528 probe sets (11,628 probes). Seven pairs of hybridization were used to obtain independent verification of microarray results. These consisted of one pair (converter/nonconverter) of 4407-33/4407-25 non-treated Burley tobacco samples, four pairs of ethylene treated 4407-33/4407-25 samples, one pair of ethylene treated dark tobacco NL Madole/181, another pair of lines near isogenic for nicotine conversion, and one pair of naturally senesced leaves of 4407=33/25 (Table 3B).

All 14 sets of hybridizations were successful as evidenced by the Expression Report generated using detection instruments by Genome Explorations, Inc. (Memphis, Tenn.). The main reports included analyses of Noise, Scale factor, background, total probe sets, number and percentage of present and absent probe sets, signal intensity of housekeeping controls. The data were subsequently analyzed and presented using software GCOS in combination with other software. Signal comparisons between treatment pairs were made, and overall data for all respective probes for all hybridizations were compiled and the expression data were also analyzed. Results based on the signal intensities showed that only two genes, D121-AA8 and D120-AH4 and one fragment, D35-BG11, which is a partial fragment of D121-AA8, had reproducible induction in ethylene-treated converter lines when compared to non-converter lines. The signal of a gene in a converter line, for example, Burley tobacco variety 4407-33, was determined as the ratio to the signal of a gene in a related non-converter isogenic line, 4407-25. Without ethylene treatment, the ratio of converter to non-converter signals for all genes approached 1.00. To eliminate the influence of background differences, normalized signal ratios were also calculated. Normalized signal ratios are obtained by dividing the treated pair ratio with the corresponding non-pair ratio. Upon ethylene treatment and analysis, it was determined that two genes, D121-AA8 and D120-AH4, were induced in converter lines relative to non-converter lines as determined by four independent analyses. These two genes share 99.8% relative homology and their relative hybridization signals in converter varieties ranged from approximately 2 to 22 fold higher than the signals in their non-converter counterparts. Based on the normalized ratios, two actin-like, internal control clones, were not induced in converter lines. In addition, a fragment (D35-BG11), whose coding region is entirely contained in both the D121-AA8 and D120-AH4 genes, was highly induced in the same samples of paired isogenic converter and nonconverter lines. Furthermore, D121-AA8 and D120-AH4 genes were strongly induced in converter lines of isogenic dark tobacco pairs, NL Madole and 181 (8 to 28 fold), thus demonstrating that ethylene induction of these genes in converter lines was an in planta response. The same genes were identified in the comparisons made from hybridizations of naturally senesced samples of 4407-33/25 as well. RT-PCR assays of these materials using primers specific for D121-AA8 verified the microarray results for this gene.

Based on these results, the D121-AA8 gene (the cDNA sequence of which is the sequence of SEQ ID NO:5; FIG. 4)

TABLE 3B

Converter:nonconverter normalized signal ratios from GeneChip ® hybridization

| | Untreated Burley (4407-33/25) | Ethylene Treated Burley (4407-33/25) | | | | Ethylene Treated Dark (178/NL Madole) | Senescence Burley (4407-33/25) |
|---|---|---|---|---|---|---|---|
| | | Exp 1 | Exp 2 | Exp 3 | Exp 4 | | |
| Induced | | | | | | | |
| D121-AA8 | 1.03 | 2.143 | 12.90 | 5.17 | 12.19 | 16.60 | 2.57 |
| D120-AH4 | 1.44 | 1.90 | 12.74 | 2.87 | 7.55 | 8.17 | 1.69 |
| D35-BG11 | 1.73 | 2.32 | 13.06 | 22.22 | 19.10 | 28.76 | 3.40 |
| Control | | | | | | | |
| Actin-Like I (5') | 1.18 | 0.99 | 0.74 | 0.73 | 0.57 | 1.02 | 0.97 |
| Actin-Like I (3') | 1.09 | 1.12 | 0.81 | 1.08 | 0.79 | 0.93 | 0.85 | was identified as the tobacco nicotine demethylase gene of interest. In view of the p450 nomenclature rule, it was determined that D121-AA8 is most similar to the p450s in the CYP82E family (The *Arabidopsis* Genome Initiative (AGI) and The *Arabidopsis* Information Resource (TAIR); Frank, *Plant Physiol.* 110: 1035-1046, 1996; Whitbred et al., *Plant Physiol.* 124:47-58, 2000); Schopfer and Ebel, *Mol. Gen. Genet.* 258:315-322, 1998; and Takemoto et al., *Plant Cell Physiol.* 40:1232-1242, 1999).

EXAMPLE 10

Biochemical Analysis of Enzymatic Activity

Biochemical analysis, for example, as described in previously filed applications that are incorporated herein by reference, determined that the sequence of SEQ ID NO:5 encodes a tobacco nicotine demethylase (SEQ ID NO:3 ).

In particular, the function of candidate clone D121-AA8 was confirmed as the coding gene for nicotine demethylase, by assaying enzyme activity of heterologously expressed p450 in yeast cells as follows.

1. Construction of Yeast Expression Vector

The putative protein-coding sequence of the tobacco nicotine demethylase-encoding cDNA (D121-AA8), D120-AH4, D121-AA8, 208-AC-8, and D208-AD9, were cloned into the yeast expression vector pYeDP60. Appropriate BamHI and MfeI sites (underlined below) were introduced via PCR primers containing these sequences either upstream of the translation start codon (ATG) or downstream of the stop codon (TAA). The MfeI on the amplified PCR product is compatible with the EcoRI site on the vector. The primers used to amplify the D121-AA8 cDNA were 5'-TAGCTACGC GGATCCATGCTTTCTCCCATAGAAGCC-3' (SEQ ID NO:2194) and 5'-CTGGATCACAATTGTT AGTGATGGT-GATGGTGATGCGATCCTCTATAAAGCTCAGGTG CCAGGC-3' (SEQ ID NO:2297). A segment of sequence coding nine extra amino acids at the C-terminus of the protein, including six histidines, was incorporated into the reverse primer to facilitate expression of 6-His tagged p450 upon induction. PCR products were ligated into pYeDP60 vector after enzyme digestions in the sense orientation with reference to the GAL10-CYC1 promoter. Proper construction of the yeast expression vectors was verified by restriction enzyme analysis and DNA sequencing. In addition, expression of the p450 proteins was visualized on SDS-PAGE gel electrophoresis for the detergent phase of the yeast micorsomes. The predicted size of the p450 proteins is 59 kD, based on the gene sequence; a result that was confirmed by the gel analysis.

2. Yeast Transformation

The WAT11 yeast line, modified to express *Arabidopsis* NADPH-cytochrome p450 reductase ATR1, was transformed with the pYeDP60-p450 cDNA plasmids. Fifty micro-liters of WAT11 yeast cell suspension was mixed with ~1 µg plasmid DNA in a cuvette with 0.2-cm electrode gap. One pulse at 2.0 kV was applied by an Eppendorf electroporator (Model 2510). Cells were spread onto SGI plates (5 g/L bactocasamino acids, 6.7 g/L yeast nitrogen base without amino acids, 20 g/L glucose, 40 mg/L DL-tryptophan, 20 g/L agar). Transformants were confirmed by PCR analysis performed directly on randomly selected colonies.

3. p450 Expression in Transformed Yeast Cells

Single yeast colonies were used to inoculate 30 mL SGI media (5 g/L bactocasamino acids, 6.7 g/L yeast nitrogen base without amino acids, 20 g/L glucose, 40 mg/L DL-tryptophan) and grown at 30° C. for about 24 hours. An aliquot of this culture was diluted 1:50 into 1000 mL of YPGE media (10 g/L yeast extract, 20 gL bacto peptone, 5 g/L glucose, 30 ml/L ethanol) and grown until glucose was completely consumed as indicated by the colorimetric change of a Diastix urinalysis reagent strip (Bayer, Elkhart, Ind.). Induction of cloned P450 was initiated by adding DL-galactose to a final concentration of 2%. The cultures were grown for an additional 20 hours before used for in vivo activity assay or for microsome preparation.

WAT11 yeast cells expressing pYeDP60-CYP71D20 (a p450 catalyzing the hydroxylation of 5-epi-aristolochene and 1-deoxycapsidiol in *Nicotiana tabacum*) were used as control for the p450 expression and enzyme activity assays.

To evaluate the effectiveness of the yeast expression of the p450 in great detail, reduced CO difference spectroscopy was performed. The reduced CO spectrum exhibited a peak at 450 nm proteins from all four p450 transformed yeast lines. No similar peaks were observed in control microsomes derived from control, untransformed yeast cells or the blank, vector control yeast cells. The results indicated that p450 proteins were expressed effectively in yeast lines harboring the pYeDP60-CYP 450. Concentrations of expressed p450 protein in yeast microsome ranged from 45 to 68 nmole/mg of total protein.

4. In Vivo Enzyme Assay

The nicotine demethylase activity in the transformed yeast cells were assayed by feeding of yeast culture with DL-Nicotine (Pyrrolidine-2-$^{14}$C). $^{14}$C labeled nicotine (54 mCi/mmol) was added to 75 µl of the galactose-induced culture for a final concentration of 55 µM. The assay culture was incubated with shaking in 14 ml polypropylene tubes for 6 hours and was extracted with 900 µl methanol. After spinning, 20 µl of the methanol extract was separated with an rp-HPLC and the nornicotine fraction was quantitated by LSC.

The control culture of WAT11 (pYeDP60-CYP71D20) did not convert nicotine to nornicotine, showing that the WAT11 yeast strain does not contain endogenous enzyme activities that can catalyze the step of nicotine bioconversion to nornicotine. In contrast, yeast expressing the tobacco nicotine demethylase gene produced detectable amount of nornicotine, indicating the nicotine demethylase activity of the translation product of SEQ ID NO:4 or SEQ ID NO:5.

5. Yeast Microsome Preparation

After induction by galactose for 20 hours, yeast cells were collected by centrifugation and washed twice with TES-M buffer (50 mM Tris-HCl, pH 7.5, 1 mM EDTA, 0.6 M sorbitol, 10 mM 2-mercaptoethanol). The pellet was resuspended in extraction buffer (50 mM Tris-HCl, pH 7.5, 1 mM EDTA, 0.6 M sorbitol, 2 mM 2-mercaptoethanol, 1% bovine serum album, Protease Inhibitor Cocktail (Roche) at 1 tablet/50 ml). Cells were then broken with glass beads (0.5 mm in diameter, Sigma) and the cell extract was centrifuged for 20 min at 20,000×g to remove cellular debris. The supernatant was subjected to ultracentrifugation at 100,000×g for 60 min and the resultant pellet contained the microsomal fraction. The microsomal fraction was suspended in TEG-M buffer (50 mM Tris-HCl, pH 7.5, 1 mM EDTA, 20% glycerol and 1.5 mM 2-mercaptoethanol) at protein concentration of 1 mg/mL. Microsomal preparations were stored in a liquid nitrogen freezer until use.

6. Enzyme Activity Assay in Yeast Microsomal Preparations

Nicotine demethylase activity assays with yeast microsomal preparations were performed. In particular, DL-Nicotine (Pyrrolidine-2-$^{14}$C) was obtained from Moravek Biochemicals and had a specific activity of 54 mCi/mmol. Chlorpromazine (CPZ) and oxidized cytochrome c (cyt. C), both P450 inhibitors, were purchased from Sigma. The reduced form of nicotinamide adenine dinucleotide phosphate (NADPH) is the typical electron donor for cytochrome P450 via the NADPH:cytochrome P450 reductase. NADPH was omitted for control incubation. The routine enzyme assay included microsomal proteins (around 1 mg/ml), 6 mM NADPH, and 55 µM $^{14}$C labeled nicotine. The concentration of CPZ and Cyt. C, when used, was 1 mM and 100 µM, respectively. The reaction was carried at 25° C. for 1 hour and was stopped with the addition of 300 µl methanol to each 25 µl reaction mixture. After centrigugation, 20 µl of the methanol extract was separated with a reverse-phase High Performance Liquid Chromatography (HPLC) system (Agilent) using an Inertsil ODS-3 3µ (150×4.6 mm) chromatography column from Varian. The isocratic mobile phase was the mixture of methanol and 50 mM potassium phosphate buffer, pH 6.25, with ratio of 60:40 (v/v) and the flow rate was 1 ml/min. The nornicotine peak, as determined by comparison with authentic non-labeled nornicotine, was collected and subjected to 2900 tri-carb Liquid Scintillation Counter (LSC) (Perkin Elmer) for quantification. The activity of nicotine demethylase is calculated based on the production of $^{14}$C labeled nornicotine over 1 hour incubation.

p450-like activity was observed in microsomal preparations from control yeast cells expressing CYP71D20 and the three test p450 yeast cultures transformed with the genes D120-AH4, D208-AC8, and D208-AD9. However, the control and the three test p450s did not show any nornicotine conversion formation suggesting that they did not contain an endogenous or induced enzyme that can catalyze the demethylation of nicotine. In contrast, results from HPLC and LSC analyses showed detectable quantities of nornicotine produced from the demethylation of nicotine using microsomal samples obtained from yeast cells expressing the tobacco nicotine demethylase gene (D121-AA8). These results indicate that the nicotine demethylase activity results from the D121-AA8 gene product. The nicotine demethylase activity required NADPH and was shown to be inhibited by p450 specific inhibitors, consistent with tobacco nicotine demethylase being a p450. The enzyme activity for tobacco nicotine demethylase (D121-AA8) was approximately 10.8 pKat/mg protein as calculated by radioactive intensity and protein concentrations. A typical set of enzyme assay results obtained for the yeast cells is shown in the following table (Table 4).

Omission of NADPH from the assay using microsomes derived from D121-AA8 yeast cells resulted in the abolishment of nicotine demethylase activity; hence no nornicotine was formed (Table 4). When two known P450 inhibitors, Chlorpromazine (CPZ, 1 mM) and oxidized cytochrome c (cyt C, 100 µM,) were added into the enzyme assay mixtures separately and incubated for 1 hour before adding the methanol stop solution, nicotine demethylase activities were decreased significantly (Table 4). Together these experiments demonstrated that D121-AA8 encodes a cytochrome p450 protein that catalyzes the conversion of nicotine to nornicotine when expressed in yeast.

EXAMPLE 11

Related Amino Acid Sequence Identity of Isolated Nucleic Acid Fragments

The amino acid sequences of nucleic acid sequences obtained for cytochrome p450 fragments from Example 8 were deduced. The deduced region corresponded to the amino acid immediately after the GXRXCP(A/G) (SEQ ID NO:2273) sequence motif to the end of the carboxyl-terminus, or stop codon. Upon comparison of sequence identity of the fragments, a unique grouping was observed for those sequences with 70% amino acid identity or greater. A preferred grouping was observed for those sequences with 80% amino acid identity or greater, more preferred with 90% amino acid identity or greater, and a most preferred grouping for those sequences 99% amino acid identity of greater. Several of the unique nucleic acid sequences were found to have complete amino acid identity to other fragments and therefore only one member with the identical amino acid was reported.

The amino acid identity for Group 19 of Table 5 corresponded to three distinct groups based on their nucleic acid sequences. The amino acid sequence of group members and their identity is shown in FIG. 5H. The amino acid differences are indicated.

At least one member of each amino acid identity group was selected for gene cloning and functional studies using plants. In addition, group members that are differentially affected by ethylene treatment or other biological differences as assessed by Northern and Southern analysis were selected for gene cloning and functional studies. To assist in gene cloning, expression studies and whole plant evaluations, peptide specific antibodies can be prepared based on sequence identity and differential sequence.

TABLE 4

DEMETHYLASE ACTIVITY IN MICROSOMES OF YEAST CELLS EXPRESSING D121-AA8 AND CONTROL P450 GENES

| Sample | Microsomes | Microsomes + 1 mM chlorpromazine | Microsomes + 100 µM cytochrome C | Microsomes − NADPH |
|---|---|---|---|---|
| D121-AA8 | 10.8 ± 1.2* pkat/mg protein | 1.4 ± 1.3 pkat/mg protein | 2.4 ± 0.7 pkat/mg protein | 0.4 ± 0.1 pkat/mg protein |
| Control (CYP71D20) | Not Detected | Not Detected | Not Detected | Not Detected |

*n = 12, others n = 3

TABLE 5

Nicotiana p450 Amino Acid Sequence Identity Groups

| GROUP | FRAGMENTS |
|---|---|
| 1 | D58-BG7 (SEQ ID NO: 11), D58-AB1 (SEQ ID NO: 13) |
| 2 | D58-BE4 (SEQ ID NO: 17) |
| 3 | D56-AH7 (SEQ ID NO: 19); D13a-5 (SEQ ID NO: 21) |
| 4 | D56-AG10 (SEQ ID NO: 23); D34-62 (SEQ ID NO: 27) |
| 5 | D56-AA7 (SEQ ID NO: 29); D56-AE1 (SEQ ID NO: 31); 185-BD3 (SEQ ID NO: 153) |
| 6 | D35-BB7 (SEQ ID NO: 33); D177-BA7 (SEQ ID NO: 35); D56A-AB6 (SEQ ID NO: 37); D144-AE2 (SEQ ID NO: 39) |
| 7 | D56-AG11 (SEQ ID NO: 41); D179-AA1 (SEQ ID NO: 43) |
| 8 | D56-AC7 (SEQ ID NO: 45); D144-AD1 (SEQ ID NO: 47) |
| 9 | D144-AB5 (SEQ ID NO: 49) |
| 10 | D181-AB5 (SEQ ID NO: 51); D73-AC9 (SEQ ID NO: 53) |
| 11 | D56-AC12 (SEQ ID NO: 55) |
| 12 | D58-AB9 (SEQ ID NO: 57); D56-AG9 (SEQ ID NO: 59); D56-AG6 (SEQ ID NO: 61); D35-BG11 (SEQ ID NO: 63); D35-42 (SEQ ID NO: 65); D35-BA3 (SEQ ID NO: 67); D34-57 (SEQ ID NO: 69); D34-52 (SEQ ID NO: 71) |
| 13 | D56AD10 (SEQ ID NO: 75) |
| 14 | D56-AA11 (SEQ ID NO: 77) |
| 15 | D177-BD5 (SEQ ID NO: 79); D177-BD7 (SEQ ID NO: 93) |
| 16 | D56A-AG10 (SEQ ID NO: 81); D58-BC5 (SEQ ID NO: 83); D58-AD12 (SEQ ID NO: 85) |
| 17 | D56-AC11 (SEQ ID NO: 87); D56-AD6 (SEQ ID NO: 97) |
| 18 | D73A-AD6 (SEQ ID NO: 99) |
| 19 | D70A-AB5 (SEQ ID NO: 105); D70A-AB8 (SEQ ID NO: 109); D70A-BH2 (SEQ ID NO: 111); D70A-AA4 (SEQ ID NO: 113); D70A-BA1 (SEQ ID NO: 115); D70A-BA9 (SEQ ID NO: 117) |
| 20 | D70A-BD4 (SEQ ID NO: 119) |
| 21 | D181-AC5 (SEQ ID NO: 121); D144-AH1 (SEQ ID NO: 123); D34-65 (SEQ ID NO: 125) |
| 22 | D35-BG2 (SEQ ID NO: 127) |
| 23 | D73A-AH7 (SEQ ID NO: 129) |
| 24 | D58-AA1 (SEQ ID NO: 131); D185-BC1 (SEQ ID NO: 143); D185-BG2 (SEQ ID NO: 145) |
| 25 | D73-AE10 (SEQ ID NO: 133) |
| 26 | D56-AC12 (SEQ ID NO: 135) |
| 27 | D177-BF7 (SEQ ID NO: 137); 185-BD2 (SEQ ID NO: 149) |
| 28 | D73A-AG3 (SEQ ID NO: 139) |
| 29 | D70A-AA12 (SEQ ID NO: 141); D176-BF2 (SEQ ID NO: 95) |
| 30 | D176-BC3 (SEQ ID NO: 155) |
| 31 | D176-BB3 (SEQ ID NO: 157) |
| 32 | D186-AH4 (SEQ ID NO: 15) |

EXAMPLE 12

Related Amino Acid Sequence Identity of Full-Length Clones

The nucleic acid sequence of full-length Nicotiana genes cloned in Example 5 were deduced for their entire amino acid sequence. Cytochrome p450 genes were identified by the presence of three conserved p450 domain motifs, which corresponded to UXXRXXZ (SEQ ID NO:2274), PXRFXF (SEQ ID NO:2275) or GXRXC (SEQ ID NO:2276) at the carboxyl-terminus where U is E or K, X is any amino acid and Z is P, T, S or M. All p450 genes were characterized for amino acid identity using a BLAST program comparing their full-length sequences to each other and to known tobacco genes. The program used the NCBI special BLAST tool (Align two sequences (bl2seq),ncbi.nlm.nih.gov/blast/b12seq/b12.html on the World Wide Web). Two sequences were aligned under BLASTN without filter for nucleic acid sequences and BLASTP for amino acid sequences. Based on their percentage amino acid identity, each sequence was grouped into identity groups where the grouping contained members that shared at least 85% identity with another member. A preferred grouping was observed for those sequences with 90% amino acid identity or greater, a more preferred grouping had 95% amino acid identity or greater, and a most preferred grouping had those sequences 99% amino acid identity or greater. Using these criteria, 25 unique groups were identified and are depicted in Table 6. The amino acid sequence of the full-length nicotine demethylase gene was deduced to have the sequence provided in SEQ ID NO:5.

Within the parameters used for Table 6 for amino acid identity, three groups were found to contain greater than 85% or greater identity to known tobacco genes. Members of Group 5 had up to 96% amino acid identity for the full-length sequence to GenBank sequence GI:14423327 (SEQ ID NO:2271) (or AAK62346). Group 23 had up to 93% amino acid identity to GI:14423328 (SEQ ID NO:2277) (or AAK62347) and Group 24 had 92% identity to GI:14423318 (SEQ ID NO:2278) (or AAK62343; SEQ ID NO:2300).

TABLE 6

Amino Acid Sequence Identity Groups of Full-Length Nicotiana p450 Genes

| | |
|---|---|
| 1 | D208-AD9 (SEQ ID NO: 233); D120-AH4 (SEQ ID NO: 189); D121-AA8 (SEQ ID NO: 191), D122-AF10 (SEQ ID NO: 193); D103-AH3 (SEQ ID NO: 231); D208-AC8 (SEQ ID NO: 227); D235-AB1 (SEQ ID NO: 255) |
| 2 | D244-AD4 (SEQ ID NO: 259); D244-AB6 (SEQ ID NO: 283); D285-AA8 (SEQ ID NO: 2205); D285-AB9 (SEQ ID NO: 2206); D268-AE2 (SEQ ID NO: 279) |
| 3 | D100A-AC3 (SEQ ID NO: 177); D100A-BE2 (SEQ ID NO: 2209) |
| 4 | D205-BE9 (SEQ ID NO: 285); D205-BG9 (SEQ ID NO: 211); D205-AH4 (SEQ ID NO: 303) |
| 5 | D259-AB9 (SEQ ID NO: 269); D257-AE4 (SEQ ID NO: 277); D147-AD3 (SEQ ID NO: 203) |
| 6 | D249-AE8 (SEQ ID NO: 265); D-248-AA6 (SEQ ID NO: 263) |
| 7 | D233-AG7 (SEQ ID NO: 275); D224-BD11 (SEQ ID NO: 249); DAF10 |
| 8 | D105-AD6 (SEQ ID NO: 181); D215-AB5 (SEQ ID NO: 229); D135-AE1 (SEQ ID NO: 199) |
| 9 | D87A-AF3 (SEQ ID NO: 225), D210-BD4 (SEQ ID NO: 273) |
| 10 | D89-AB1 (SEQ ID NO: 159); D89-AD2 (SEQ ID NO: 161); D163-AG11 (SEQ ID NO: 207); D163-AF12 (SEQ ID NO: 205) |
| 11 | D267-AF10 (SEQ ID NO: 305); D96-AC2 (SEQ ID NO: 169); D96-AB6 (SEQ ID NO: 167); D207-AA5 (SEQ ID NO: 213); D207-AB4 (SEQ ID NO: 215); D207-AC4 (SEQ ID NO: 217) |
| 12 | D98-AG1 (SEQ ID NO: 173); D98-AA1 (SEQ ID NO: 171) |
| 13 | D209-AA12 (SEQ ID NO: 221); D209-AA11; D209-AH10 (SEQ ID NO: 223); D209-AH12 (SEQ ID NO: 241); D90A-BB3 (SEQ ID NO: 163) |
| 14 | D129-AD10 (SEQ ID NO: 197); D104A-AE8 (SEQ ID NO: 179) |
| 15 | D228-AH8 (SEQ ID NO: 253); D228-AD7 (SEQ ID NO: 251), D250-AC11 (SEQ ID NO: 267); D247-AH1 (SEQ ID NO: 261) |
| 16 | D128-AB7 (SEQ ID NO: 195); D243-AA2 (SEQ ID NO: 257); D125-AF11 (SEQ ID NO: 237) |
| 17 | D284-AH5 (SEQ ID NO: 307); D110-AF12 (SEQ ID NO: 185) |
| 18 | D221-BB8 (SEQ ID NO: 243) |
| 19 | D222-BH4 (SEQ ID NO: 245) |
| 20 | D134-AE11 (SEQ ID NO: 239) |
| 21 | D109-AH8 (SEQ ID NO: 183) |
| 22 | D136-AF4 (SEQ ID NO: 287) |
| 23 | D237-AD1 (SEQ ID NO: 235) |
| 24 | D112-AA5 (SEQ ID NO: 187) |
| 25 | D283-AC1 (SEQ ID NO: 281) |

The full-length genes were further grouped based on the highly conserved amino acid homology between UXXRXXZ p450 domain (SEQ ID NO:2274) and GXRXC p450 domain (SEQ ID NO:2276) near the end the carboxyl-terminus. As shown in FIGS. 160A to 160E, individual clones were aligned based on the sequence homology between the conserved domains and placed in distinct identity groups. In several cases, although the nucleic acid sequence of the clone was unique, the amino acid sequence for the region was identical. The preferred grouping was observed for those sequences with 90% amino acid identity or greater, a more preferred group had 95% amino acid identity or greater, and a most preferred grouping had those sequences 99% amino acid identity of greater. The final grouping was similar to that based on the percent identity for the entire amino acid sequence of the clones except for Group 17 (of Table 6) which was divided into two distinct groups.

Within the parameters used for amino acid identity in Table 7, three groups were found to contain 90% or greater identity to known tobacco genes. Members of Group 5 had up to 93.4% amino acid identity for full length sequences to the GenBank sequence of GI:14423326 (SEQ ID NO:2279) (or AAK62346). Group 23 had up to 91.8% amino acid identity to GI:14423328 (SEQ ID NO:2277) (or AAK62347) and Group 24 had 98.8% identity to GI:14423318 (SEQ ID NO:2278) (or AAK62342).

TABLE 7

Amino Acid Sequence Identity Groups of Regions between Conserved Domains of *Nicotiana* p450 Genes 1 D208-AD9 (SEQ ID NO: 233); D120-AH4 (SEQ ID NO: 189); D121-AA8 (SEQ ID NO: 191), D122-AF10 (SEQ ID NO: 193); D103-AH3 (SEQ ID NO: 231); D208-AC8 (SEQ ID NO: 227); D235-AB1 (SEQ ID NO: 255)
2 D244-AD4 (SEQ ID NO: 259); D244-AB6 (SEQ ID NO: 283); D285-AA8 (SEQ ID NO: 2205); D285-AB9 (SEQ ID NO: 2206); D268-AE2 (SEQ ID NO: 279)
3 D100A-AC3 (SEQ ID NO: 177); D100A-BE2 (SEQ ID NO: 2209)
4 D205-BE9 (SEQ ID NO: 285); D205-BG9 (SEQ ID NO: 211); D205-AH4 (SEQ ID NO: 303)
5 D259-AB9 (SEQ ID NO: 269); D257-AE4 (SEQ ID NO: 277); D147-AD3 (SEQ ID NO: 203)
6 D249-AE8 (SEQ ID NO: 265); D-248-AA6 (SEQ ID NO: 263)
7 D233-AG7 (SEQ ID NO: 275); D224-BD11 (SEQ ID NO: 249); DAF10
8 D105-AD6 (SEQ ID NO: 181); D215-AB5 (SEQ ID NO: 229); D135-AE1 (SEQ ID NO: 199)
9 D87A-AF3 (SEQ ID NO: 225), D210-BD4 (SEQ ID NO: 273)
10 D89-AB1 (SEQ ID NO: 159); D89-AD2 (SEQ ID NO: 161); D163-AG11 (SEQ ID NO: 207); D163-AF12 (SEQ ID NO: 205)
11 D267-AF10 (SEQ ID NO: 305); D96-AC2 (SEQ ID NO: 169); D96-AB6 (SEQ ID NO: 167); D207-AA5 (SEQ ID NO: 213); D207-AB4 (SEQ ID NO: 215); D207-AC4 (SEQ ID NO: 217)
12 D98-AG1 (SEQ ID NO: 173); D98-AA1 (SEQ ID NO: 171)
13 D209-AA12 (SEQ ID NO: 221); D209-AA11; D209-AH10 (SEQ ID NO: 223); D209-AH12 (SEQ ID NO: 241); D90A-BB3 (SEQ ID NO: 163)
14 D129-AD10 (SEQ ID NO: 197); D104A-AE8 (SEQ ID NO: 179)
15 D228-AH8 (SEQ ID NO: 253); D228-AD7 (SEQ ID NO: 251), D250-AC11 (SEQ ID NO: 267); D247-AH1 (SEQ ID NO: 261)
16 D128-AB7 (SEQ ID NO: 195); D243-AA2 (SEQ ID NO: 257); D125-AF11 (SEQ ID NO: 237)
17 D284-AH5 (SEQ ID NO: 307); D110-AF12 (SEQ ID NO: 185)
18 D221-BB8 (SEQ ID NO: 243)
19 D222-BH4 (SEQ ID NO: 245)
20 D134-AE11 (SEQ ID NO: 239)
21 D109-AH8 (SEQ ID NO: 183)
22 D136-AF4 (SEQ ID NO: 285)
23 D237-AD1 (SEQ ID NO: 235)
24 D112-AA5 (SEQ ID NO: 187)
25 D283-AC1 (SEQ ID NO: 281)
26 D110-AF12 (SEQ ID NO: 185)

EXAMPLE 13

*Nicotiana* Cytochrome P450 Clones Lacking One or More of the Tobacco P450 Specific Domains Four clones had high nucleic acid homology, ranging 90% to 99% nucleic acid homology, to other tobacco cytochrome genes reported in Table 6. The four clones included D136-AD5 (SEQ ID NO:292), D138-AD12 (SEQ ID NO:294), D243-AB3 (SEQ ID NO:298) and D250-AC11 (SEQ ID NO:300). However, due to a nucleotide frameshift, these genes did not contain one or more of three C-terminus cytochrome p450 domains and were excluded from identity groups presented in Table 6 or Table 7.

The amino acid identity of one clone, D95-AG1, did not contain the third domain, GXRXC (SEQ ID NO:2276), used to group p450 tobacco genes in Table 6 or Table 7. The nucleic acid sequence of this clone had low homology to other tobacco cytochrome genes and, therefore, this clone represents a novel group of cytochrome p450 genes in *Nicotiana*.

EXAMPLE 14

Use of *Nicotiana* Cytochrome P450 Fragments and Clones in Altered Regulation of Tobacco Qualities The use of tobacco p450 nucleic acid fragments or whole genes are useful in identifying and selecting those plants that have altered tobacco phenotypes or tobacco constituents and, more importantly, altered metabolites. Transgenic tobacco plants are generated by a variety of transformation systems that incorporate nucleic acid fragments or full-length genes, selected from those reported herein, in orientations for either down-regulation, for example anti-sense orientation, or over-expression for example, sense orientation and the like. For over-expression to full-length genes, any nucleic acid sequence that encodes the entire or a functional part or amino acid sequence of the full-length genes described in this invention is desirable. Such nucleic acid sequences desirably are effective for increasing the expression of a certain enzyme and thus resulting in phenotypic effect within *Nicotiana*. *Nicotiana* lines that are homozygous are obtained through a series of backcrossing and assessed for phenotypic changes including, but not limited to, analysis of endogenous p450 RNA, transcripts, p450 expressed peptides and concentrations of plant metabolites using techniques commonly available to one having ordinary skill in the art. The changes exhibited in the tobacco plants provide information on the functional role of the selected gene of interest or are of use as preferred *Nicotiana* plant species.

EXAMPLE 15

Cloning of the Genomic Tobacco Nicotine Demethylase from Converter Burley Tobacco Genomic DNA was extracted from converter Burley tobacco plant line 4407-33 (a *Nicotiana tabacum* variety 4407 line) using Qiagen Plant Easy kit as described in above Examples (see also the manufacturer's procedure).

The primers were designed based on the 5' promoter and 3' UTR region cloned in previous examples. The forward primers were 5'-GGC TCT AGA TAA ATC TCT TAA GTT ACT AGG TTC TAA-3' (SEQ ID NO:2280) and 5'-TCT CTA AAG TCC CCT TCC -3' (SEQ ID NO:2288) and the reverse primers were 5'-GGC TCT AGA AGT CAA TTA TCT TCT ACA AAC CTT TAT ATA TTA GC-3' (SEQ ID NO:2281), and 5'-CCA GCA TTC CTC AAT TTC -3' (SEQ ID NO:2289). PCR was applied to the 4407-33 genomic DNA with 100 μl of reaction mix. Pfx high fidelity enzyme was used for PCR amplification. The PCR product was visualized on 1% agarose gel after electrophoresis. A single band with molecular weight of approximately 3.5 kb was observed and excised from the gel. The resulting band was purified using a gel purification kit (Qiagen; based on manufacturer's procedure). The purified DNA was digested by enzyme Xba I (NEB; used according to the manufacturer's instructions). The pBluescript plasmid was digested by Xba I using same procedure. The fragment was gel purified and ligated to pBluescript plasmid. The ligation mix was transformed into competent cell GM1O9 and plated onto LB plate containing 100 mg/l of ampicillin with blue/white selection. The white colonies were picked and grown into 10 ml LB liquid media containing ampicillin. The DNA was extracted by miniprep. The plasmid DNA containing the insert was sequenced using a CEQ 2000 sequencer (Beckman, Fullerton, Calif.) based on the manufacturer's procedure. The T3 and T7 primers and 8 other internal primers were used for sequencing. The sequence was assembled and analyzed, thus providing the genomic sequence (SEQ ID NO:4 ). Based on the genomic sequence, it was determined that the nicotine demethylase gene in both converter and nonconverter tobacco lines does not contain a transposable element.

Comparison of the sequence of SEQ ID NO:5 with the sequence of SEQ ID NO:4 allowed the determination of a single intron within the coding portion of the gene (identified as the sequence of SEQ ID NO:7). As shown in FIG. 1, the genomic structure of the tobacco nicotine demethylase includes two exons flanking a single intron. The first exon spans nucleotides 2010 to 2949 of SEQ ID NO:4, which encodes amino acids 1-313 of SEQ ID NO:3, and the second exon spans nucleotides 3947 to 4562 of SEQ ID NO:4, which encode amino acids 314-517 of SEQ ID NO:3. Accordingly, the intron spans nucleotides 2950-3 946 of SEQ ID NO:4. The intron sequence is provided in SEQ ID NO:7. The translation product of the genomic DNA sequence is provided in SEQ ID NO:3. The tobacco nicotine demethylase amino acid sequence contains an endoplasmic reticulum membrane anchoring motif.

EXAMPLE 16

Cloning 5' Flanking Sequences (SEQ ID NO:8) and 3'UTR (SEQ ID NO:9) from Converter Tobacco A. Isolation of Total DNA from Converter Tobacco Leaves Tissue Genomic DNA was isolated from leaves of converter tobacco 4407-33. The isolation of DNA was performed using a DNeasy Plant Mini Kit from the company Qiagen, Inc. (Valencia, Calif.) according to the manufacturer's protocol. The manufacturer's manual Dneasy' Plant Mini and DNeasy Plant Maxi Handbook, Qiagen January 2004 is incorporated hereby as reference. The procedure for DNA preparation included the following steps: Tobacco leaf tissue (approximately 20 mg dry weight) was ground to a fine powder under liquid nitrogen for 1 minute. The tissue powder was transferred into a 1.5 ml tube. Buffer AP1 (400 µl) and 4 µl of RNase stock solution (100 mg/ml) were added to a maximum of 100 mg of ground leaf tissue and vortexed vigorously. The mixture was incubated for 10 min at 65° C. and mixed 2-3 times during incubation by inverting tube. Buffer AP2 (130 µl) was then added to the lysate. The mixture was mixed and incubated for 5 min on ice. The lysate was applied to a QIAshredder Mini Spin Column and centrifuged for 2 min (14,000 rpm). The flow-through fraction was transferred to a new tube without disturbing the cell-debris pellet. Buffer AP3/E (1.5 volumes) was then added to the cleared lysate and mixed by pipetting. The mixture (650 µl) from the preceding step including any precipitate was applied to a DNeasy Mini Spin Column. The mixture was centrifuged for 1 min at >6000×g (>8000 rpm) and the flow-through was discarded. This was repeated with the remaining sample and the flow-through and collection tube were discarded. DNeasy Mini Spin Column was placed in a new 2 ml collection tube. Then buffer AW (500 µl) was added to the DNeasy column and centrifuged for 1 min (>8000 rpm). The flow-through was discarded. The collection tube was reused in the next step. Buffer AW (500 µl) was then added to the DNeasy column and centrifuged for 2 min (>14,000 rpm) in order to dry the membrane. The DNeasy column was transferred to a 1.5 ml tube. Then Buffer AE (100 µl) was pipetted onto the DNeasy membrane. The mixture was incubated for 5 min at room temperature (15-25° C.) and then centrifuged for 1 min (>8000 rpm) to elute.

The quality and quantity of the DNA was estimated by running samples on an agarose gel.

B. Cloning of 5' Flanking Sequences of the Structural Gene

A modified inverse PCR method was used to clone 750 nucleotides of the 5' flanking sequences of the structural gene from SEQ ID NO:5. First, appropriate restriction enzymes were selected based on the restriction site in the known sequence fragment and the restriction sites distance downstream of the 5' flanking sequences. Two primers were designed based on this known fragment. The forward primer was located downstream of the reverse primer. The reverse primer was located in the 3' portion of the known fragment.

The cloning procedure included the following steps:

The purified genomic DNA (5 µg) was digested with 20-40 units of the appropriate restriction enzyme (EcoRI and SpeI) in a 50 µl reaction mixture. An agarose gel electrophoresis with a ⅒ volume of the reaction mixture was performed to determine if the DNA was digested to completion. A direct ligation was performed after thorough digestion by ligating overnight at 4° C. A reaction mixture of 200 µl containing 10 µl of digested DNA and 0.2 µl of T4 DNA ligase (NEB) was ligated overnight at 4° C. PCR on the ligation reaction was performed after an artificial small circular genome was obtained. PCR was performed with 10 µl of ligation reaction and 2 primers from known fragments in two different directions in 50 µl reaction mixture. A gradient PCR program with annealing temperatures of 45-56° C. was applied.

Agarose gel electrophoresis was performed to check the PCR reaction. The desired band was cut from the gel and a QIAquick gel purification Kit from QIAGEN was used to purify the band. The purified PCR fragments were ligated into a pGEM-T Easy Vector (Promega, Madison, Wis.) following manufacturer's instructions. The transformed DNA plasmids were extracted by miniprep using SV Miniprep kit (Promega, Madison, Wis.) following the manufacturer's instructions. Plasmid DNA containing the insert was sequenced using a CEQ 2000 sequencer (Beckman, Fullerton, Calif.). Approximately 758 nt (nucleotides 1241-2009 of SEQ ID NO:4) of the 5' flanking sequence were cloned by the method described above.

C. Cloning of the Longer 5' Flanking Sequences (SEQ ID NO:8; FIG. 6) of the Structural Gene BD GenomeWalker Universal Kit (Clontech laboratories, Inc., PaloAlto, Calif.) was used for cloning additional 5' flanking sequence of the structural gene, D121-AA8 according to the manufacturer's user manual. The manufacturer's manual BD GenomeWalker August, 2004 is incorporated hereby as reference. The size and purity of tobacco genomic DNA were tested by running samples on a 0.5% agarose gel. A total of 4 blunt-end reactions (DRA I, STU I, ECOR V, PVU II) were set up for tobacco 33 library genome walking construction. After purification of the digested DNAs, the digested genomic DNAs were ligated to the genome walker adaptor. Primary PCR reactions were applied to the four digested DNA's by using adaptor primer AP1 and the gene specific primer from D121-AA8 (CTCTATTGATAC- TAGCTGGTTTTGGAC; SEQ ID NO:2282). The primary PCR products were used directly as templates for the nested PCR. The adaptor nested primer provided by the kit and the nested primer from the known clone D121-AA8 (SEQ ID NO:5) (GGAGGGAGAGTATAACTTACGGATTC; SEQ ID NO:2283) were used in the PCR reaction. PCR products were checked by running gel electrophoreses. The desired bands were sliced out from the gel, and the PCR fragments were purified using QIAquick gel purification Kit from QIAGEN. The purified PCR fragments were ligated into a pGEM-T Easy Vector (Promega, Madison, Wis.) following manufacturer's instructions. The transformed DNA plasmids were extracted by miniprep using the SV Miniprep kit (Promega, Madison, Wis.) and following the manufacturer's instructions. Plasmid DNA containing the insert was sequenced using a CEQ 2000 sequencer (Beckman, Fullerton, Calif.). Another approximately 853 nt of the 5' flan king sequence, including nucleotides 399-1240 of SEQ ID NO:4, were cloned by the method described above.

A second round of the genome walking was performed according to the same method with the difference that the following primers GWR1A (5'-AGTAACCGATTGCT-CACGTTATCCTC-3') (SEQ ID NO:2284) and GWR2A (5'-CTCTATTCAACCCCACACGTAACTG-3') (SEQ ID NO:2285) were used. Another approximately 398 nt of flanking sequence, including nucleotides 1-398 of SEQ ID NO:4, were cloned by this method.

A search for regulatory elements revealed that, in addition to "TATA" box, "CAAT" boxes, and "GAGA" boxes, several MYB-like recognition sites and organ specificity elements are present in the tobacco nicotine demethylase promoter region. Putative elicitor responsive elements and nitrogen-regulated elements, identified using standard methods, are also present in the promoter region.

D. Cloning of 3' Flanking Sequences of the Structural Gene

BD GenomeWalker Universal Kit (Clontech laboratories, Inc., PaloAlto, Calif.) was used for cloning of 3' flanking sequence of the structural gene, D121-AA8 according to the manufacturer's user manual. The cloning procedure is the same as describes in the preceding Section C of this example, except for the gene specific primers. The first primer was designed from close to the end of D121-AA8 structural gene (5'-CTA AAC TCT GGT CTG ATC CTG ATA CTT-3') (SEQ ID NO:2286). The nested primer was designed further downstream of primer 1 of the D121-AA8 structural gene (CTA TAC GTA AGG TAA ATC CTG TGG AAC) (SEQ TD NO:2287). The final PCR products were checked by gel electrophoreses. The desired bands were excised from the gel. The PCR fragments were purified using QlAquick gel purification Kit from QIAGEN. The purified PCR fragments were ligated into a pGEM-T Easy Vector (Promega, Madison, Wis.) following manufacturer's instructions. The transformed DNA plasmids were extracted by miniprep using SV Miniprep kit (Promega, Madison, Wis.) following manufacturer's instructions. Plasmid DNA containing the insert was sequenced using a CEQ 2000 sequencer (Beckman, Fullerton, Calif.). Approximately 1617 nucleotides of additional 3' flanking sequence (nucleotides 4731-6347 of SEQ ID NO:4) were cloned by the method described above. The nucleic acid sequence of the 3' UTR region is set forth in SEQ ID NO:9.

EXAMPLE 17

Screening the *Nicotiana* Genus for the Presence or Absence of a Nicotine Demehtylase Gene Forty-three *Nicotiana* species, forty-nine *Nicotiana* rustica lines, and approximately six hundred *Nicotiana tabacum* lines were seeded in pots and the resulting plants were grown in the greenhouse as shown in Table 8 below.

TABLE 8

| Scientific Name or Common Name or Source | Inventory Number |
| --- | --- |
| *Nicotiana africana* | TW6 |
| *Nicotiana amplexicaulis* | TW10 |
| *Nicotiana arentsii* | TW12 |
| *Nicotiana attenuata* | TW13 |
| *Nicotiana benavidesii* | TW 15 |
| *Nicotiana benthamiana* | TW16 |
| *Nicotiana bigelovii* | TW18 |
| *Nicotiana bonariensis* | TW 28 |
| *Nicotiana clevelandii* | TW30 |
| *Nicotiana corymbosa* | TW35 |
| *Nicotiana debneyi* | TW36 |
| *Nicotiana excelsior* | TW46 |
| *Nicotiana exigua* | TW48 |
| *Nicotiana glauca* | TW 53 |
| *Nicotiana glutinosa* | TW58 |
| *Nicotiana goodspeedii* | TW67 |
| *Nicotiana gossei* | TW68 |
| *Nicotiana hesperis* | TW69 |
| *Nicotiana ingulba* | TW71 |
| *Nicotiana kawakamii* | TW 72 |
| *Nicotiana knightiana* | TW73 |
| *Nicotiana maritima* | TW82 |
| *Nicotiana megalosiphon* | TW83 |
| *Nicotiana miersii* | TW85 |
| *Nicotiana nesophila* | TW87 |
| *Nicotiana noctiflora* | TW88 |
| *Nicotiana nudicaulis* | TW90 |
| *Nicotiana otophora* | TW94 |
| *Nicotiana palmeri* | TW98 |
| *Nicotiana paniculata* | TW99 |
| *Nicotiana petunioides* | TW105 |
| *Nicotiana plumbaginifolia* | TW106 |
| *Nicotiana repanda* | TW110 |
| *Nicotiana rosulata* | TW112 |
| *Nicotiana rotundifolia* | TW114 |
| *Nicotiana rustica* | TW116 |
| *Nicotiana setchelli* | TW121 |
| *Nicotiana solanifolia* | TW123 |
| *Nicotiana stocktonii* | TW126 |
| *Nicotiana eastii* | TW127 |
| *Nicotiana suaveolens* | TW128 |
| *Nicotiana thrysiflora* | TW139 |
| *Nicotiana tomentosa* | TW140 |
| *Nicotiana tomentosiformis* | TW142 |
| *Nicotiana trigonophylla* | TW143 |
| *Nicotiana undulata* | TW145 |
| 4384-HHS | TR1 |
| 43103-5 | TR10 |
| 43104-1 | TR11 |
| 4401 | TR12 |
| Brasilia #7 | TR13 |
| Brasilia #23 | TR14 |
| Brasilia Selvaggio | TR15 |
| Brasilia | TR16 |
| Erbasanta | TR17 |
| 68 Olson | TR18 |
| C 39-193 | TR19 |
| 4385 L-5-6 | TR2 |
| German #2 | TR20 |
| German #1 | TR21 |
| Mahorka #1 | TR22 |
| Mahorka #2 | TR23 |
| Mahorka #3 | TR24 |
| Mahorka #4 | TR25 |

TABLE 8-continued

| Scientific Name or Common Name or Source | Inventory Number |
|---|---|
| Mahorka #5 | TR26 |
| Mahorka #6 | TR27 |
| Mahorka #7 | TR28 |
| Mahorka #8 | TR29 |
| 4386 L-5-6 | TR3 |
| Mahorka #9 | TR30 |
| Mahorka #10 | TR31 |
| Mahorka #11 | TR32 |
| Mahorka #12 | TR33 |
| Kostoff | TR34 |
| Bak #46 | TR35 |
| Koriotes | TR36 |
| Jainkaya Sol | TR37 |
| Jainkaya bl | TR38 |
| Drosqi | TR39 |
| 4390 L-5-2-1 | TR4 |
| 14 No.23057 | TR40 |
| Edinburg 25 | TR41 |
| Ja.Bot.Car. | TR42 |
| R.Bot.Car. | TR43 |
| HARBIN | TR44 |
| Normal | TR45 |
| Matsui | TR46 |
| Buni | TR47 |
| DUMONT | TR48 |
| Chinensis | TR49 |
| 4398 L-5-2-1 | TR5 |
| Campanulata | TR50 |
| Acutifolia | TR51 |
| Fructicosa | TR52 |
| Acutifolia | TR53 |
| Nordugel | TR54 |
| GC-1 | TR55 |
| Hasankeyf | TR56 |
| PNE 241-5 | TR57 |
| PNE 362-4 | TR58 |
| PNE 369-3 | TR59 |
| 4399 L-5-2-1 | TR6 |
| PNE 373-13 | TR60 |
| PNE 407-5 | TR61 |
| PNE 412-8 | TR62 |
| PNE 417-4 | TR63 |
| PNE 418-6 | TR64 |
| PNE 420-6 | TR65 |
| PNE 427-4 | TR66 |
| TI 1674 | TR67 |
| TI 1685 | TR68 |
| TI 1686 | TR69 |
| 43054 | TR7 |
| TI 1693 | TR70 |
| Rustica | TR71 |
| Rustica | TR72 |
| Rustica | TR73 |
| Rustica | TR74 |
| Rustica | TR75 |
| Rustica | TR76 |
| Rustica | TR77 |
| Selection from PI499194 | TR78 |
| Selection from PI499200 | TR79 |
| 43101 | TR8 |
| Selection from PI499206 | TR80 |
| 93024 | TR81 |
| Rustica | TR82 |
| Florida 301 | TC 195 |
| DF 300 | TC 465 |
| Mos Res Black Mammoth | TC 481 |
| Tom Rossen (TR) Madole | TC 486 |
| MS KY 16 | TC 521 |
| NC-BMR 42 | TC 570 |
| N. tabacum KDH-926 | TC 575 |
| N. tabacum KDH-959 | TC 576 |
| N. tabacum KDH-960 | TC 577 |
| Nance | TC 616 |
| TN D94 | TC 621 |
| Burley Mammoth KY16 | TC12 |
| Ex. 12 | TC13 |
| Golden Burley | TC14 |
| GR 2 | TC15 |
| GR 5 | TC16 |
| GR 6 | TC17 |
| GR 13 | TC21 |
| KY153 | TC216 |
| KY157 | TC217 |
| KY163 | TC219 |
| GR 14 | TC22 |
| KY165 | TC220 |
| Little Sweet Orinoco | TC221 |
| Little Yellow | TC222 |
| Madole (NN) | TC223 |
| One Sucker | TC224 |
| Virginia 312 | TC228 |
| GR 17 | TC23 |
| GR 18 | TC25 |
| GR 19 | TC26 |
| GR 36 | TC28 |
| GR 38 | TC29 |
| GR 38A | TC30 |
| GR 40 | TC31 |
| GR 42 | TC32 |
| GR 42C | TC33 |
| GR 43 | TC34 |
| GR 44 | TC35 |
| GR 45 | TC36 |
| GR 53 | TC39 |
| Greenbrior | TC40 |
| H-47 | TC42 |
| Harouova | TC43 |
| Harrow 12 | TC44 |
| Harrow Velvet | TC45 |
| Aurelius | TC459 |
| Harwill | TC46 |
| Black Mammoth | TC460 |
| Browleaf | TC462 |
| D-534-A-1 | TC464 |
| DF 516 | TC467 |
| DF 911 | TC468 |
| HI Burley 21 | TC47 |
| Improved Madole | TC471 |
| Jernigan's Madole | TC472 |
| Kentucky 151 | TC473 |
| Little Crittenden | TC476 |
| Lizard Tail Orinoco | TC477 |
| Improved Brior | TC48 |
| Mos Res (MR/NN) Madole | TC480 |
| Mos Res Little Crittenden | TC482 |
| Mos Res Little Wood | TC483 |
| Narrow Leaf (NL) Madole | TC484 |
| Sears Special | TC485 |
| VA 310 | TC487 |
| Walkers Broadleaf | TC489 |
| Judy's Pride | TC49 |
| Woods | TC490 |
| Baur | TC491 |
| Bel MS-1 | TC492 |
| Bel MS-2 | TC493 |
| Catterton | TC494 |
| Dean | TC495 |
| Gertz | TC496 |
| Keller | TC497 |
| Maryland 10 | TC498 |
| Maryland 14 D2 | TC499 |
| Kelly Brownleaf | TC50 |
| Maryland 21 | TC500 |
| Maryland 59 | TC501 |
| Maryland 64 | TC502 |
| Maryland 201 | TC503 |
| Maryland 341 | TC504 |
| Maryland Stand-Up Mammoth | TC508 |
| MD B100 | TC509 |
| Kelly Burley | TC51 |
| Moore | TC511 |
| Posey | TC512 |

TABLE 8-continued

| Scientific Name or Common Name or Source | Inventory Number |
|---|---|
| Robinson Med Broadleaf | TC513 |
| Sweeney | TC514 |
| Thompson | TC515 |
| Ward | TC516 |
| Wilson | TC517 |
| MS 400 | TC518 |
| MS 402 | TC519 |
| KY1 | TC52 |
| MS Burley1 | TC520 |
| MS PA Swarr Hibshman | TC523 |
| SB 400 | TC524 |
| SB Burley 1 | TC526 |
| K5 | TC53 |
| Samsun | TC536 |
| Samsun (PHYB)-1 | TC537 |
| Samsun (PHYB)-2 | TC538 |
| KY9 | TC54 |
| Samsun Holmes (NN) | TC540 |
| Samsun NO 15 | TC541 |
| Samsun-BLK SHK Tol | TC542 |
| Smyrna | TC543 |
| Smyrna NO 9 | TC544 |
| Smyrna NO 23 | TC545 |
| Smyrna-BLK SHK Tol | TC546 |
| Stanimaka NO 20 | TC547 |
| Turkish | TC548 |
| Xanthi (Mitchell-Mor) | TC549 |
| Xanthi (Smith) | TC550 |
| Xanthi Yaka NO 18A | TC552 |
| Xanthi-Parental | TC554 |
| Perique | TC556 |
| KY12 | TC56 |
| VA 309 | TC560 |
| VA 409 | TC562 |
| KYBSS | TC565 |
| NC-BMR 90 | TC571 |
| KDH-926 | TC575 |
| KDH-926 | TC575 |
| KDH-959 | TC576 |
| KDH-959 | TC576 |
| KDH-960 | TC577 |
| C8 | TC578 |
| VA 331 | TC592 |
| Smith TO 448A | TC594 |
| LN KY 171 | TC605 |
| SI KY 171 | TC607 |
| SI KY 160 | TC608 |
| KY19 | TC61 |
| IG KY 171 | TC610 |
| IG KY 160 | TC611 |
| PY KY 160 | TC612 |
| PY KY 171 | TC613 |
| Shirey | TC617 |
| TN D950 | TC622 |
| VA 355 | TC638 |
| VA 359 | TC639 |
| OS 802 | TC640 |
| Black Mammoth SM Stalk | TC641 |
| Elliot Madole | TC643 |
| Goose Creek Red | TC644 |
| Little Wood | TC645 |
| KY56 | TC72 |
| KY57 | TC73 |
| KY58 | TC74 |
| Uniform | TC83 |
| Warner | TC86 |
| Yellow Twist Bud | TC88 |
| Venezuela | TI 106 |
| N. tabacum Hoja parado (Galpoa) | TI 1068 |
| Argentina | TI 1068 |
| Peru | TI 1075 |
| Turkey | TI 1217 |
| Turkey | TI 1218 |
| Turkey | TI 1219 |
| Turkey | TI 1222 |
| Turkey | TI 1223 |
| Turkey | TI 1224 |
| Turkey | TI 1225 |
| Turkey | TI 1229 |
| Turkey | TI 1230 |
| Turkey | TI 1235 |
| Turkey | TI 1236 |
| Turkey | TI 1237 |
| Spain | TI 1239 |
| Spain | TI 1245 |
| Spain | TI 1246 |
| Spain | TI 1247 |
| Spain | TI 1250 |
| Spain | TI 1251 |
| Spain | TI 1253 |
| Yugoslavia | TI 1254 |
| Paraguay | TI 1255 |
| Ethiopia | TI 1268 |
| Ethiopia | TI 1269 |
| Ethiopia | TI 1270 |
| Ethiopia | TI 1271 |
| Korea, South | TI 1278 |
| Brazil | TI 128 |
| Korea, South | TI 1280 |
| Yugoslavia | TI 1282 |
| Yugoslavia | TI 1283 |
| Yugoslavia | TI 1284 |
| Yugoslavia | TI 1285 |
| Yugoslavia | TI 1286 |
| Yugoslavia | TI 1287 |
| Brazil | TI 129 |
| Yugoslavia | TI 1291 |
| Yugoslavia | TI 1292 |
| Yugoslavia | TI 1293 |
| Yugoslavia | TI 1295 |
| Yugoslavia | TI 1296 |
| Yugoslavia | TI 1297 |
| Bolivia | TI 1301 |
| Bolivia | TI 1302 |
| Argentina | TI 1306 |
| Papua New Guinea | TI 1311 |
| Greece | TI 1313 |
| New Zealand | TI 1315 |
| New Zealand | TI 1317 |
| New Zealand | TI 1318 |
| Yugoslavia | TI 1320 |
| Yugoslavia | TI 1321 |
| Yugoslavia | TI 1322 |
| Yugoslavia | TI 1324 |
| Yugoslavia | TI 1325 |
| Yugoslavia | TI 1326 |
| Yugoslavia | TI 1327 |
| Yugoslavia | TI 1329 |
| Yugoslavia | TI 1332 |
| Yugoslavia | TI 1333 |
| Austria | TI 1349 |
| Cuba | TI 1373 |
| Cuba | TI 1375 |
| Cuba | TI 1376 |
| Bulgaria | TI 1378 |
| Bulgaria | TI 1379 |
| Bulgaria | TI 1380 |
| Bulgaria | TI 1380 |
| Bulgaria | TI 1381 |
| Bulgaria | TI 1382 |
| Bulgaria | TI 1383 |
| Bulgaria | TI 1384 |
| Bulgaria | TI 1385 |
| Bulgaria | TI 1386 |
| Bulgaria | TI 1387 |
| Bulgaria | TI 1388 |
| Bulgaria | TI 1389 |
| Bulgaria | TI 1407 |
| Bulgaria | TI 1408 |
| Bulgaria | TI 1409 |
| Bulgaria | TI 1410 |
| Bulgaria | TI 1411 |

TABLE 8-continued

| Scientific Name or Common Name or Source | Inventory Number |
|---|---|
| Bulgaria | TI 1412 |
| Italy | TI 1414 |
| Liberia | TI 1426 |
| Liberia | TI 1427 |
| Poland | TI 1444 |
| Cuba | TI 1452 |
| Cuba | TI 1453 |
| Brazil | TI 1455 |
| Germany | TI 1459 |
| Germany | TI 1460 |
| Spain | TI 1485 |
| Bulgaria | TI 1492 |
| Bulgaria | TI 1493 |
| Bulgaria | TI 1494 |
| Bulgaria | TI 1496 |
| Switzerland | TI 1506 |
| Australia | TI 1507 |
| Australia | TI 1508 |
| Germany | TI 1532 |
| Germany | TI 1533 |
| Belgium | TI 1534 |
| Belgium | TI 1535 |
| Austria | TI 1536 |
| Italy | TI 1538 |
| Iran | TI 1555 |
| Iran | TI 1556 |
| United States | TI 1561 |
| United States | TI 1562 |
| United States | TI 1563 |
| Poland | TI 1567 |
| Poland | TI 1568 |
| Poland | TI 1569 |
| Poland | TI 1570 |
| Japan | TI 158 |
| Japan | TI 1594 |
| Italy | TI 1595 |
| Italy | TI 1596 |
| Italy | TI 1599 |
| Italy | TI 1600 |
| Italy | TI 1601 |
| Italy | TI 1602 |
| Rhodesia | TI 1603 |
| Japan | TI 1604 |
| Japan | TI 1605 |
| Yugoslavia | TI 1623 |
| United States | TI 186 |
| United States | TI 187 |
| United States | TI 240 |
| United States | TI 241 |
| United States | TI 271 |
| Colombia | TI 291 |
| United States | TI 331 |
| Romania | TI 380 |
| Romania | TI 381 |
| United States | TI 395 |
| United States | TI 396 |
| United States | TI 444 |
| United States | TI 480 |
| United States | TI 484 |
| United States | TI 486 |
| United States | TI 532 |
| United States | TI 538 |
| Colombia | TI 540 |
| Colombia | TI 541 |
| Honduras | TI 567 |
| Honduras | TI 568 |
| Ecuador | TI 569 |
| Algeria | TI 69 |
| Honduras | TI 706 |
| Iran | TI 73 |
| Venezuela | TI 776 |
| Former Soviet Union | TI 86 |
| Former Soviet Union | TI 87 |
| Former Soviet Union | TI 88 |
| Former Soviet Union | TI 90 |
| Former Soviet Union | TI 92 |
| Former Soviet Union | TI 93 |
| Former Soviet Union | TI 94 |
| Brazil | TI 97 |
| Brazil | TI 975 |
|  | TI1007 |
|  | TI1025 |
|  | TI1026 |
| Tabaco Corriente | TI105 |
| Ambireno | TI1050 |
| Cuba | TI1061 |
| Lampazo | TI1067 |
| Hoja Parado (Galpao) | TI1068 |
| Judi Pride Bertel | TI1075 |
| Americano Tracuateua | TI108 |
| Guayabito | TI1080 |
| Crillo Saltono | TI1082 |
| Crillo Saltono | TI1083 |
| Chileno Colorado, Hoja Anjosta | TI1085 |
| Chileno Grande Colorado | TI1095 |
| Creja De Mula | TI1119 |
| Chinese X Amarellinho | TI1143 |
| Cubano De La Sierra | TI115 |
|  | TI119 |
|  | TI1211 |
|  | TI1215 |
|  | TI1277 |
|  | TI1288 |
| Begej | TI1331 |
| Fodya | TI1350 |
|  | TI1352 |
| Oxviz | TI1356 |
| Kulsko | TI1380 |
| Tekne | TI1388 |
| Nuk | TI1397 |
| Amarillo Rio Grande Do Sul | TI14 |
| Guacharo U.S.A. | TI1473 |
|  | TI1482 |
|  | TI1484 |
| Rippel | TI1498 |
| Amarelao | TI1499 |
| Immune 580 MS | TI1501 |
| W.K. 39 | TI1502 |
| Sirone | TI1508 |
| Espado | TI151 |
| Simmaba | TI152 |
| Russian Burley | TI1534 |
| Vorstenladen | TI1541 |
| Selesion Olor | TI1543 |
| NF 2617 | TI1550 |
| NFC 2 | TI1551 |
| Kutsaga E-1 | TI1552 |
| CH T.Z. 273-3B | TI1556 |
| Beinhart 1000-1 | TI1561 |
| Lonibow | TI1573 |
| A17 | TI1574 |
| A22 | TI1575 |
| A23 | TI1576 |
| Parado | TI1583 |
| Quin Diaz | TI1585 |
| Ke-Shin No. 1 | TI1592 |
| BT 101 | TI1594 |
| Shiroenshu 201 | TI1604 |
| Higo | TI161 |
| Lonibow | TI1613 |
| Little Gold 1025 | TI1618 |
| MA-Song-Ta | TI1619 |
| Nanbu | TI162 |
| Tan-Yuh-1 | TI1620 |
| Veliki Hercegovac | TI1623 |
| (S.P.I. 27525) | TI178 |
| Cordoba | TI198 |
| Virginia | TI220 |
| Virginia | TI222 |
| No. 3 | TI230 |
| Cordoba | TI255 |
| Cordoba | TI257 |

TABLE 8-continued

| Scientific Name or Common Name or Source | Inventory Number |
|---|---|
| Cordoba | TI260 |
| Cordoba | TI268 |
| Cubano | TI295 |
|  | TI301 |
| Hoja Ancha | TI309 |
|  | TI312 |
| Chocoa | TI313 |
| Palmira | TI318 |
| Cubano | TI323 |
|  | TI341 |
|  | TI343 |
|  | TI350 |
|  | TI382 |
| Zapatoca | TI384 |
| Tachuleo | TI385 |
| Arcial Chico | TI394 |
|  | TI407 |
| Copan | TI421 |
| Virginia | TI424 |
|  | TI429 |
| Tachuelo | TI432 |
| Cordoncillo | TI438 |
| Repello and Bravo Negro | TI445 |
|  | TI447 |
| Costillo Nigro, Blanco, Pina | TI450 |
| Hubana and Palmira | TI476 |
| Colorado | TI508 |
|  | TI510 |
|  | TI514 |
| Chaco Chivo | TI515 |
| Kentucky | TI527 |
|  | TI528 |
| Tabaco Blanco | TI530 |
|  | TI554 |
| Cacho Do Chivo | TI560 |
| Dolores De Copan | TI562 |
| Barbasco | TI578 |
|  | TI582 |
|  | TI592 |
|  | TI596 |
|  | TI606 |
|  | TI629 |
| Blanco, Colorado | TI630 |
| Tlapacoyan | TI645 |
|  | TI657 |
|  | TI661 |
| Oja-De-Vastago | TI665 |
| Chanchamayo | TI687 |
| Daule | TI691 |
|  | TI717 |
| Amarillo Riogrande | TI74 |
| Monte Libano | TI764 |
|  | TI785 |
| Virginia | TI789 |
|  | TI792 |
| Cacerio De Songoy | TI794 |
| Gumo | TI797 |
|  | TI822 |
| Negro or Salom | TI870 |
| Capadare and Rabo De Gallo | TI889 |
|  | TI946 |
| Rabo De Gallo | TI955 |
| Virginia Bright | TI964 |
| KY171(ph_) | 04GH#105-1 |
| KY171(ph_) | 04GH#105-2 |
| KY171(ph_) | 04GH#105-3 |
| KY171(ph_) | 04GH#105-4 |
| KY171(ph_) | 04GH#105-5 |
| KY171(ph_) | 04GH#105-6 |
| KY171(ph_) | 04GH#107-1 |
| KY171(ph_) | 04GH#107-2 |
| KY171(ph_) | 04GH#107-3 |
| KY171(ph_) | 04GH#107-4 |
| KY171(ph_) | 04GH#107-5 |
| KY171(ph_) | 04GH#107-6 |
| NL.Madole (ph_) | 04GH#114-1 |
| NL.Madole (ph_) | 04GH#114-2 |
| NL.Madole (ph_) | 04GH#114-3 |
| NL.Madole (ph_) | 04GH#114-4 |
| NL.Madole (ph_) | 04GH#114-5 |
| NL.Madole (ph_) | 04GH#114-6 |
| NL.Madole (ph_) | 04GH#115-1 |
| NL.Madole (ph_) | 04GH#115-2 |
| NL.Madole (ph_) | 04GH#115-3 |
| NL.Madole (ph_) | 04GH#115-4 |
| NL.Madole (ph_) | 04GH#115-5 |
| NL.Madole (ph_) | 04GH#115-6 |
| TN D950 (ph_) | 04GH#124-1 |
| TN D950 (ph_) | 04GH#124-2 |
| TN D950 (ph_) | 04GH#124-3 |
| TN D950 (ph_) | 04GH#124-4 |
| TN D950 (ph_) | 04GH#124-5 |
| TN D950 (ph_) | 04GH#124-6 |
| TN D950 (ph_) | 04GH#125-1 |
| TN D950 (ph_) | 04GH#125-2 |
| TN D950 (ph_) | 04GH#125-3 |
| TN D950 (ph_) | 04GH#125-4 |
| TN D950 (ph_) | 04GH#125-5 |
| TN D950 (ph_) | 04GH#125-6 |
| Basma(PhPh) | 04GH#68 |
| KY14 | 86-00-K-7-1 |

Leaf samples were taken from six-week-old plants. DNA extractions from the leaves were performed using DNeasy Plant Mini Kit (Qiagen, Inc., Valencia, Calif.) according to manufacturer's protocol.

The primers were designed based on the 5' promoter and 3' UTR regions described herein. The forward primer was 5'-GGC TCT AGA TAA ATC TCT TAA GTT ACT AGG TTC TAA-3' (SEQ ID NO:2290) and the reverse primer was 5'-GGC TCT AGA AGT CAA TTA TCT TCT ACA AAC CTT TAT ATA TTA GC-3' (SEQ ID NO:2291) (from −750 of the 5' flanking region to 180 nt 3' UTR). Genomic DNA extracted from all above-mentioned *Nicotiana* lines was used for the PCR analysis. A 100 μl reaction mixture and the Pfx high fidelity enzyme were used for PCR amplification. The annealing temperature used was 54° C. due to less homology among the species (this temperature is 2° C. lower than the temperature used for cloning genomic sequence from 4407 converter tobacco as described above). The PCR product was visualized on 0.8% agarose gel after electrophoresis. A single band with molecular weight of approximately 3.5 kb was either present or absent on the gel. The lines with a positive band were scored as having the target gene. For the lines that lacked positive bands, four additional PCR reactions were performed using four more sets of primers. These sets of primers were selected from different regions of the gene. The four sets primers were:

(1) from the start codon (5'-GCC CAT CCT ACA GTT ACC TAT AAA AAG GAA G-3') (SEQ ID NO:2292) to the stop codon (5'-ACC AAG ATG AAA GAT CTT AGG TTT TAA-3') (SEQ ID NO:2293), (2) from 570 nt downstream of the start codon (5'-CTG ATC GTG AAG ATG A-3') (SEQ ID NO:2294) to the end of the intron (5'-TGC TGC ATC CAA GAC CA-3') (SEQ ID NO:2295), (3) from 300 nt downstream of the beginning of the intron (5'-GGG CTA TAT GGA TTC GC-3')(SEQ ID NO:2296) to the end of the intron (5'-TGC TGC ATC CAA GAC CA-3') (SEQ ID NO:2295), and (4) from 300 nt downstream of the beginning of the intron (5'-GGG CTA TAT GGA TTC GC-3') (SEQ ID NO:2296) to the 3'UTR (5'-AGT CAA TTA TCT TCT ACA AAC CTT TAT ATA TTA GC-3') (SEQ ID NO:2195).

If the five above-mentioned PCR reactions all showed no correct bands, the line was scored as lacking the target gene. Examples of the genomic DNA quantity and PCR products for the target nicotine demethylase gene are depicted in FIGS. 8 and 9.

Germplasm identified as lacking the nicotine demethylase gene is used as source material for breeding with cultivated tobaccos. However, any nucleic acid sequence shown in FIGS. 2 to 7 and SEQ ID NOS: 446 to 2193, or a fragment thereof, can be used in a similar manner. Interspecific or intraspecific hybridization methods combined with standard breeding methods, such as backcrossing of the pedigree method, may be used to transfer the aberrant or absent nicotine demethylase gene or any nucleic acid sequence shown in FIGS. 2 to 7 and SEQ ID NOS: 446 to 2193, or a fragment thereof, from the donor source to cultivated tobaccos. Results of screening experiments for nicotine demethylase are set forth in Table 9 below. A line negative for nicotine demethylase may be bred with itself or another negative line (e.g., *Nicotiana africana*× *Nicotiana africana* or *Nicotiana africana*×*Nicotiana amplexicaulis* or any suitable breeding combination). Negative lines are also bred with any commercial variety of tobacco according to standard tobacco breeding techniques known in the art. Tobacco lines may be bred with any other compatible plant according to standard procedures in the art.

TABLE 9

Exemplary Results from Screening the *Nicotiana* Genus for the Nicotine Demethylase Gene

| Scientific Name or Common Name or (Origin) | Inventory Number | Screening Results |
|---|---|---|
| *Nicotiana africana* | TW6 | Negative |
| *Nicotiana amplexicaulis* | TW10 | Negative |
| *Nicotiana arentsii* | TW12 | Negative |
| *Nicotiana benthamiana* | TW16 | Negative |
| *Nicotiana bigelovii* | TW18 | Negative |
| *Nicotiana corymbosa* | TW35 | Negative |
| *Nicotiana debneyi* | TW36 | Negative |
| *Nicotiana excelsior* | TW46 | Negative |
| *Nicotiana exigua* | TW48 | Negative |
| *Nicotiana glutinosa* | TW58 | Negative |
| *Nicotiana goodspeedii* | TW67 | Negative |
| *Nicotiana gossei* | TW68 | Negative |
| *Nicotiana hesperis* | TW69 | Negative |
| *Nicotiana ingulba* | TW71 | Negative |
| *Nicotiana knightiana* | TW73 | Negative |
| *Nicotiana maritima* | TW82 | Negative |
| *Nicotiana megalosiphon* | TW83 | Negative |
| *Nicotiana miersii* | TW85 | Negative |
| *Nicotiana nesophila* | TW87 | Negative |
| *Nicotiana noctiflora* | TW88 | Negative |
| *Nicotiana nudicaulis* | TW90 | Negative |
| *Nicotiana otophora* | TW94 | Positive |
| *Nicotiana palmeri* | TW98 | Negative |
| *Nicotiana paniculata* | TW99 | Negative |
| *Nicotiana petunioides* | TW105 | Negative |
| *Nicotiana plumbaginifolia* | TW106 | Negative |
| *Nicotiana repanda* | TW110 | Negative |
| *Nicotiana rosulata* | TW112 | Negative |
| *Nicotiana rotundifolia* | TW114 | Negative |
| *Nicotiana rustica* | TW116 | Negative |
| *Nicotiana setchelli* | TW121 | Negative |
| *Nicotiana stocktonii* | TW126 | Negative |
| *Nicotiana eastii* | TW127 | Negative |
| *Nicotiana suaveolens* | TW128 | Negative |
| *Nicotiana thrysiflora* | TW139 | Positive |
| *Nicotiana tomentosa* | TW140 | Positive |
| *Nicotiana tomentosiformis* | TW142 | Positive |
| *Nicotiana trigonophylla* | TW143 | Negative |
| NL Madole | Foundation seed | Positive |

TABLE 9-continued

Exemplary Results from Screening the *Nicotiana* Genus for the Nicotine Demethylase Gene

| Scientific Name or Common Name or (Origin) | Inventory Number | Screening Results |
|---|---|---|
| KY 14 | Foundation seed | Positive |
| TN 86 | Foundation seed | Positive |
| Coker 176 | Foundation seed | Positive |
| KY21 | TC62 | Positive |
| KY22 | TC63 | Positive |
| KY24 | TC64 | Positive |
| KY26 | TC65 | Positive |
| KY33 | TC66 | Positive |
| KY34 | TC67 | Positive |
| KY35 | TC68 | Positive |
| KY41A | TC69 | Positive |
| KY54 | TC71 | Positive |
| KY52 | TC70 | Positive |
| Virginia 528 | TC85 | Positive |
| Virginia B-29 | TC86 | Positive |
| 401 Cherry Red | TC227 | Positive |
| 401 Cherry Red Free | TC228 | Positive |
| KY170 | TC474 | Positive |
| KY171 | TC475 | Positive |
| Maryland 609 | TC505 | Positive |
| Maryland Mammoth | TC507 | Positive |
| VA403 | TC580 | Positive |
| KY908 | TC630 | Positive |
| Earl Jennett Madole | TC642 | Positive |
| Kavala | TC533 | Positive |
| Kavala No 15A | TC534 | Positive |
| GR 10 | TC 19 | Positive |
| GR 10A | TC20 | Positive |
| GR 24 | TC27 | Positive |
| NOD 9 | TI 1745 | Positive |
| NOD 12 | TI 1747 | Positive |
| NOD 17 | TI 1749 | Positive |
| 80111 Pudawski 66CMS | TI 1661 | Positive |
| 84160 Pudawski 66 | TI 1683 | Positive |
| MII 109 | TI 1715 | Positive |
| Mississippi Heirloom | TI 1716 | Positive |
| Ovens 62 | TI 1741 | Positive |
| BT 101 | TI 1594 | Positive |
| Kentucky MI 429 | TI 1595 | Positive |
| Shiroenshu 201 | TI 1604 | Positive |
| Shiroenshu 202 | TI 1605 | Positive |
| Ostrolist 2747 II | TI 1568 | Positive |
| Ergo | TI 1349 | Positive |
| Burley 323 | TI 1535 | Positive |
| Russian Burley | TI 1534 | Positive |
| Puremozhetz 83 | TI 1569 | Positive |
| Bulsunov 80 | TI 1537 | Positive |
| Amarillo Riogrande | TI74 | Positive |
| Espado | TI151 | Positive |
| Crillo Saltono | TI1082 | Positive |
| Kutsaga E-1 | TI1552 | Positive |
| Beinhart 1000-1 | TI1561 | Positive |
| Kelly Brownleaf | TC50 | Positive |
| KY9 | TC54 | Positive |
| Black Mammoth | TC460 | Positive |
| Lizard Tail Orinoco | TC477 | Positive |
| Bel MS-2 | TC493 | Positive |
| Maryland 201 | TC503 | Positive |
| Perique | TC556 | Positive |
| NC-BMR 90 | TC571 | Positive |
| LN KY 171 | TC605 | Positive |
| Samsun | TC536 | Positive |
| Xanthi-Parental | TC554 | Positive |
| (Turkey) | TI 1222 | Positive |
| Hongrois (Spain) | TI 1246 | Positive |
| (Ethiopia) | TI 1269 | Positive |
| Ravajk(Yugoslavia) | TI 1284 | Positive |
| (Bolivia) | TI 1301 | Positive |
| Adjuctifolia (New Zealand) | TI 1317 | Positive |
| NO. 6055 (Cuba) | TI 1375 | Positive |
| (Bulgaria) | TI 1386 | Positive |
| Grande Reditto (Italy) | TI 1414 | Positive |
| (Germany) | TI 1459 | Positive |

TABLE 9-continued

Exemplary Results from Screening the *Nicotiana* Genus
for the Nicotine Demethylase Gene

| Scientific Name or<br>Common Name or (Origin) | Inventory<br>Number | Screening<br>Results |
|---|---|---|
| (Switzerland) | TI 1506 | Positive |
| Sirone (Australia) | TI 1508 | Positive |
| Dubek 566 (Poland) | TI 1567 | Positive |
| Kagoshima Maruba (Japan) | TI 158 | Positive |
| Erzegovina Lecce MI 411 (Italy) | TI 1602 | Positive |
| (Colombia) | TI 291 | Positive |
| Okso (Former Soviet Union) | TI 86 | Positive |

EXAMPLE 18

Creating or Generating Mutations and Screening for Genetic Variation in the Nicotine Demethylase Gene Preexisting genetic variation or mutations in the sequence coding for the nicotine demethylase or any other genes represented by a nucleic acid sequence shown in FIGS. 2 to 7 and SEQ ID NOS: 446 to 2193, or a fragment thereof screened using molecular technologies including targeted induced local lesions in genomes (TILLING), DNA fingerprinting methods such as amplified fragment length polymorphisms (AFLP), and single nucleotide polymorphisms (SNP). In practice, plant populations representing preexisting genetic variation such as a transgenic plant (e.g., any of those described herein) or those created by exposing reproductive tissues, seed, or other plant tissues to chemical mutagens such as alkylating agents, ethane methyl sulfonate (EMS) for example, or to radiation such as x-rays or gamma rays are used. For mutagenized populations the dosage of the mutagenic chemical or radiation is determined experimentally for each type of plant tissue such that a mutation frequency is obtained that is below a threshold level characterized by lethality or reproductive sterility. The number of M1 generation seed or the size of M1 plant populations resulting from the mutagenic treatments are estimated based upon the expected frequency of mutations. The progeny, M2 generation, of the M1 plants represent the population that desirably is evaluated for a mutation in a gene, e.g., the nicotine demethylase gene.

Tilling, DNA fingerprinting, SNP or similar technologies may be used to detect induced or naturally-occurring genetic variation in a desirable gene such as the nicotine demethylase gene. The variation may result from deletions, substitutions, point mutations, translocations, inversions, duplications, insertions or complete null mutations. These technologies could be used in a marker-assisted selection (MA breeding program) to transfer or breed the null or dissimilar alleles of the nicotine demethylase gene or any nucleic acid sequence shown in FIGS 2 to 7 and SEQ ID NOS: 446 to 2193, or a fragment thereof, into other tobaccos. A breeder could create segregating populations from hybridizations of a genotype containing the null or dissimilar allele with an agronomically desirable genotype. Plants in the F2 or backcross generations could be screened using a marker developed from the nicotine demethylase sequence or a nucleic acid sequence shown in FIGS. 2 to 7 and SEQ ID NOS: 446 to 2193, or a fragment thereof, using one of the techniques listed previously. Plants identified as possessing the null or dissimilar alleles could be backcrossed or self-pollinated to create the next population that could be screened. Depending on the expected inheritance pattern or the MAS technology used, it may be necessary to self-pollinate the selected plants before each cycle of backcrossing to aid identification of the desired individual plants. Backcrossing or other breeding procedure can be repeated until the desired phenotype of the recurrent parent is recovered.

EXAMPLE 19

Breeding or Transfer of Variant Nictoine Demethylase Gene Expression Into Cultivated Tobacco A. Selection of Parental Lines Donor tobacco lines are identified as those having variant nicotine demethylase gene expression (e.g., a tobacco line identified using a PCR-based strategy as lacking the nicotine demethylase gene or is null for nicotine demethylase or expressing a nicotine demethylase having altered enzymatic activity; or a tobacco line expressing a transgene that alters or silences gene expression is also considered to be variant for nicotine demethylase gene expression) or variants of any nucleic acid sequence shown in FIGS. 2 to 7 and SEQ ID NOS: 446-2193, or a fragment thereof, and are selected to serve as the donor parent. Such plants are generated according to standard methods known in the art, e.g., those described herein. Other donor plants include tobacco plants that have been mutagenized and subsequently identified as having variant nicotine demethylase gene activity or variant activity of a gene product encoded by any nucleic acid sequence shown in FIGS. 2 to 7 and SEQ ID NOS: 446-2193, or a fragment thereof. One exemplary donor parent is the ne tobacco line, *Nicotiana rustica*.

The recipient tobacco line is typically any commercial tobacco variety such as *Nicotiana tabacum* TN 90. Other useful *Nicotiana tabacum* varieties include BU 64, CC 101, CC 200, CC 27, CC 301, CC 400, CC 500, CC 600, CC 700, CC 800, CC 900, Coker 176, Coker 319, Coker 371 Gold, Coker 48, CU 263, DF911, Galpao tobacco, GL 26H, GL 350, GL 737, GL 939, GL 973, HB 04P, K 149, K 326, K 346, K 358, K 394, K 399, K 730, KT 200, KY 10, KY 14, KY 160, KY 17, KY 171, KY 907, KY 160, Little Crittenden, McNair 373, McNair 944, msKY 14×L8, Narrow Leaf Madole, NC 100, NC 102, NC 2000, NC 291, NC 297, NC 299, NC 3, NC 4, NC 5, NC 6, NC 606, NC 71, NC 72, NC 810, NC BH 129, OXFORD 207, 'Perique' tobacco, PVH03, PVH09, PVH19, PVH50, PVH51, R 610, R 630, R 7-11, R 7-12, RG 17, RG 81, RG H4, RG H51, RGH 4, RGH 51, RS 1410, SP 168, SP 172, SP 179, SP 210, SP 220, SP G-28, SP G-70, SP H20, SP NF3, TN 86, TN 97, TN D94, TN D950, TR (Tom Rosson) Madole, VA 309, VA 309, or VA 359. Seed from such varieties may also be from a source resulting from screening for the lack or presence of nicotine conversion using standard chemical or molecular methods. Such commercial varieties also provide material for altering nicotine demethylase activity according to the methods described herein. Other null lines and recipient or donor lines known in the art are also useful, and lines identified as being dissimilar from the nicotine demethylase gene described herein also serve as a donor parent. Recipient lines may also be chosen from any tobacco varieties for flue-cured, Burley, dark, Virginia or Oriental tobaccos. Table 10 shows exemplary *Nicotiana* species which exhibit breeding compatibility with *Nicotiana tabacum* (see also, for example, *Compendium of Tobacco Diseases* published by APS or *The Genus Nicotiana Illustrated* published by Japan Tobacco Inc.).

TABLE 10

Exemplary *Nicotiana* species compatible with *Nicotiana tabacum*.

| Scientific Name or Common Name or (Origin) | Inventory Number | PI Number | Screening Results |
|---|---|---|---|
| *Nicotiana amplexicaulis* | TW10 | PI 271989 | Negative |
| *Nicotiana benthamiana* | TW16 | PI 555478 | Negative |
| *Nicotiana bigelovii* | TW18 | PI 555485 | Negative |
| *Nicotiana debneyi* | TW36 | | Negative |
| *Nicotiana excelsior* | TW46 | PI 224063 | Negative |
| *Nicotiana glutinosa* | TW58 | PI 555507 | Negative |
| *Nicotiana goodspeedii* | TW67 | PI 241012 | Negative |
| *Nicotiana gossei* | TW68 | PI 230953 | Negative |
| *Nicotiana hesperis* | TW69 | PI 271991 | Negative |
| *Nicotiana knightiana* | TW73 | PI 555527 | Negative |
| *Nicotiana maritima* | TW82 | PI 555535 | Negative |
| *Nicotiana megalosiphon* | TW83 | PI 555536 | Negative |
| *Nicotiana nudicaulis* | TW90 | PI 555540 | Negative |
| *Nicotiana paniculata* | TW99 | PI 555545 | Negative |
| *Nicotiana plumbaginifolia* | TW106 | PI 555548 | Negative |
| *Nicotiana repanda* | TW110 | PI 555552 | Negative |
| *Nicotiana rustica* | TW116 | | Negative |
| *Nicotiana suaveolens* | TW128 | PI 230960 | Negative |
| *Nicotiana sylvestris* | TW136 | PI 555569 | Negative |
| *Nicotiana tomentosa* | TW140 | PI 266379 | Positive |
| *Nicotiana tomentosiformis* | TW142 | | Positive |
| *Nicotiana trigonophylla* | TW143 | PI 555572 | Negative |

B. Gene Transfer

The donor parent is crossed or hybridized in a reciprocal manner with the donor parent according to standard breeding methods. Successful hybridizations, identified according to standard method, yield F1 plants that are fertile or that are, if desired, backcrossed with the recipient parent. A plant population in the F2 generation, derived from the F1 plant, is screened for variant nicotine demethylase gene expression (e.g., a plant is identified that fails to express nicotine demethylase due to the absence of the nicotine demethylase gene according to standard methods, for example, by using a PCR method with primers based upon the nucleotide sequence information for nicotine demethylase described herein) or variant expression of any nucleic acid sequence shown in FIGS. 2 to 7 and SEQ ID NOS: 446-2193, or a fragment thereof Alternatively, any standard screening method known in the art for evaluating plant alkaloid content is used to identify plants that do not convert nicotine to nornicotine. Selected plants are then hybridized with the recipient parent and the first backcrossed (BC1) generation plants are self-pollinated to produce a BC1F2 population that is again screened for variant nicotine demethylase gene expression (e.g., the null version of the nicotine demethylase gene). The process of backcrossing, self-pollination, and screening is repeated, for example, at least 4 times until the final screening produces a plant that is fertile and reasonably similar to the recipient parent. This plant, if desired, is self-pollinated and the progeny are subsequently screened again to confirm that the plant exhibits variant nicotine demethylase gene expression (e.g., a plant that displays the null condition for nicotine demethylase) or variant expression of any nucleic acid sequence shown in FIGS. 2 to 7 and SEO ID NOS: 446-2193, or a fragment thereof. Cytogenetic analyses of the selected plants is optionally performed to confirm the chromosome complement and chromosome pairing relationships. Breeder's seed of the selected plant is produced using standard methods including, for example, field testing, confirmation of the null condition for nicotine demethylase or null or increased condition of a polypeptide encoded by any nucleic acid sequence shown in FIGS. 2 to 7 and SEQ ID NOS: 446-2193, or a fragment thereof, and chemical analyses of cured leaf to determine the level of alkaloids especially the nomicotine content and the ratio nornicotine/nicotine+nornicotine or other such desired properties provided by those gene sequences found in any nucleic acid sequence shown in FIGS. 2 to 7 and SEQ ID NOS: 446-2193, or a fragment thereof.

In situations where the original F1 hybrid resulting from the cross between the recipient (e.g., *N. rustica*) and donor parent (e.g., TN 90) is hybridized or backcrossed to the donor (e,g., TN 90), the progeny of this backcross is self-pollinated to create a BC1F2 generation that is screened for the null or dissimilar version of nicotine demethylase or the null or increased condition of a polypeptide encoded by any nucleic acid sequence shown in FIGS. 2 to 7 and SEQ ID NOS: 446-2193, or a fragment thereof. The remainder of the breeding effort is as described in the above paragraph.

C. Agronomic Performance Testing and Confirmation of Phenotype

Lines resulting from the breeding and screening for variant nicotine demethylase gene expression (e.g., the null condition for nicotine demethylase) or of any nucleic acid sequence shown in FIGS. 2 to 7 and SEQ ID NOS: 446-2193, or a fragment thereof, are evaluated in the field using standard field procedures. Control genotypes including the original recipient parent (e.g., TN 90) are included and entries are arranged in the filed in a randomized complete block design or other appropriate field design. Standard agronomic practices for tobacco are used, for example, the tobacco is harvested, weighed, and sampled for chemical and other common testing before and during curing. Statistical analyses of the data are performed to confirm the similarity of the selected lines to the recipient, e.g., the parental line TN 90.

EXAMPLE 20

Breeding or Transfer of a Modified Attribute Into Cultivated Tobacco

Expression of any of the genes described herein, for example, any one of those nucleic acid sequences shown in FIGS 2 to 7 and SEQ ID NOS: 446-2193 may also be modified according to the methods described herein. Such genes provide a basis for modifying a plant's phenotype, for example, improving flavor or aroma or both, improving an organoleptic property, or improving curability. Plants identified as having a modified phenotype are then used in a breeding protocol according to standard methods known in the art, for example, those described herein.

EXAMPLE 21

Hybrid Plant Generation

Application of standard protoplast culture methodologies developed for production of hybrid plants using protoplast fusion is also useful for generating plants having variant gene expression (e.g., variant nicotine demethylase gene expression). Accordingly, protoplasts are generated from a first and a second tobacco plant having variant gene expression. Calli are cultured from successful protoplast fusions and plants are then regenerated. Resulting progeny hybrid plants are identified and selected for variant gene expression according to standard methods and, if desired, may be used in any standard breeding protocol.

WO 03/078577, WO 2004/035745, PCT/US/2004/034218, and PCT/US/2004/034065, and all other references, patents, patent application publications, and patent applications referred to herein are incorporated by reference herein to the same extent as if each of these references, patents, patent application publications, and patent applications were separately incorporated by reference herein.

Numerous modifications and variations in practice of the invention are expected to occur to those skilled in the art upon consideration of the foregoing detailed description of the invention. Consequently, such modifications and variations are intended to be included within the scope of the following claims.

SEQUENCE LISTING (2303 sequences)

SEQ ID NO: 1 - DNA, 177 bp, Nicotiana tabacum
atgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaa

SEQ ID NO: 2 - protein, 58 aa, Nicotiana tabacum
MTYALQVEHLTMAHLIQGFNYRTPNDEPLDMKEGAGITIRKVNPVELIIAPRLAPELY

SEQ ID NO: 3 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 4 - DNA, 6347 bp, Nicotiana tabacum
tctctaaagtccccttccactttatcttagctgtgtgatttctttcagacaaccttatttttattcagactcttatttgtattattctagaagctcgtgtacttgtgacaccagttctgggatggtatttagatatcgctattattttggcttattcacttcagttcagattttattccagttatttgatttctttattattaatcaaattgaattgttaaaaatggttaaaattactccaatgttggctttcctagtaagcgaaatatcaggcgccatcacggtacccgaaggtgagaatttcagatcgtgacagccgcatctcaaggggtgtgatgtaaacagtttacgatggtgcaagcattagtggctgcttcgacgacttaaatccgtaacttatagatcacacgaatacaactttactattttaacacccagcaaattcctgataaaaacaattctaacatagcacatcaaaatgtaaatgattgaagaaaaagatgacttttatagacagagaaaaaaacagttacgtgtggggttgaatagagattgtggctatgctatttctaatattgaaattcaccgacttttttagttcaatacgaaaagagtaagtgaaaaggtctgaaaaggaaaaggacaatgcctaaaaggacacattcagaacacatacactgaatgattctaatttctagtccgaagatttctagttcgaggataacgtgagcaatcggttacttcccattagcaattgccaactggatgtttgactatttatgtttctggccaatagaggagaggaatactacgttacgtatggagtttgaacccttcacatcaacttattaagtgagttatccctcaatcacgattcaactatgattccgctaacttcaaagaatattgagttaattattcaaatgattagtccaaaattatttaataaagttatactatttcttttatttgtaacatacatcttttgtttacatatttagttaaatcttagcccaaccctatcgttggttcgactttttttcttttaattttgatttattctgttcggtaatttcgctttgtttggcttgaataataactagtgcataaagtcatatactctaatatttttaattgaagtactcacaaatacaaaaataaaaaacattctaagctcacatgatagttgacaaaatctttatccaaaacaagaggcggagccaggatttgaaacttatgggttcagaattctaaatctcttaagttactaggttctaaattaataatttatacatgttcaatgaatttcttaagacaaatacatagtttgaacgaaagctactgggttcggccgaatccgtaagttatactctccctccgccccggtccaaaaccagctagtatcaatagagagagagagagagagagagagataataaatttgaccattgacaatggcttattacttgcttagagttaattggtgaacttagagaatataataaggaatatttaaacagatacgtcatcaatccacgagtaacgaagtaagaaataccctaaaatcgtagaaacattacgttaaattgcttgacagcctatctagtaagagtcaaaatctactatctatcttgttccgccattttcttaaagaagtacatgagctttatcatccacctcaacatgaatgcaaaagaaaattattgtgcaacttaatatgttataatcaatgatatgtgtcttgtgtaacaaagtatatatttcgatacgatattaatatgtaggtgttatatttttaaatatcaaatatcatacttaacaccgattttttaaaaacttaggccaattaccctaccaactaaaatactgtatatcaaacactaatgttttctatttcggtacgacagttctctatttaccatattatggaattatgcccatcctacagttacctataaaaaggaagttgccgatagttatattctcaacttcttatctaaaaatccataatgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttgtaagttcatctgtcatttttcatttattcacttttattttgaggagcagacatgttaataataatttggagcaactgtaaagttatctatgtgtacaggttcgagcctcaggtgcaaccactaatgcttgtattagattatgttgtctgcatcatacccctaattggagtgtggctcttcccgaaccctgcaatgctggatgctggatgctttatgtatcagactgacctttttgttaaactatctaaatactaaggatgatttaataaaaatatagaatggtaaacagaaaaagatgagattatttttggggctatatggattcgcccgggctttgggaggtaaaacggtatctaccagttgagactttactccagaactttatctcgagagctctgaataaaaatgaaatagtatttaccactccaaaatctttgatggtaaaaagatgagatataacctcttataattgattgaaccacgttgatagaataaaacttctttactcccattcagcataagaaaaatgaaaccaaacggaattcttctcttttttagggggaaattccttaattgcttgttgaatatagattcatgtcgttattctatttttaataatgatgaaaatcaatatagtcaaagttaatacttatgtcatttggtttgcggacaagttatattggaactatataatacgtctattatagaatagtgattatttagaggatatacattttttttggataaatatttgatttattggattaaaaatagaatatacaggtaaggtctaaaacgtgtgtttgcttttacactaaataaacttgacctcgtacaattctaagaaaatatttgaaataaatgaattattttattgttaatcaattaaaaaaatcatagtatagatgagatgtgtgcatacttgacaataactatactaactaaaacaaggtatgtgaataattgatattccttttttaattattcttttttccagagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatctttcatcttggttgatcattgtataatactcctaaatggatattcatttaccttttatcaattaattgtcagtacgagtttttctaatttggtacatttgtaataataagtaaagaataattgtgctaatatataaaggtttgtagaagataattgactggttgtaccacaatctccagtgaaagtgttaattatttacttgatccacagcttattctatgtttgaaatttgcctagtgtcatgatattactccatcaaattcaagaaataatcatttccaacttttgctggactggacgatctttcaataataaaggatctttaatttgccaaagttgagatcaaaatactggtcgctttaccaataagaatgaaatgtgatggaaattatgtacgttgggataagggaacacaactatcaaggagactaaaaggtacgtaaaggaaaagaaaaaatttgccattgattgctactaagtaacctaacaaaatctttcagaaaagaatcacttgtataagtcggggttgaaagttttggtgtctcttttcttatgtattgttgtctttagacagtattgtacttagttatttcagaattttattttcgtattagagctcaagactctgtatttattagttctgggagaattatcatgtattttcagtcttttgttatttctgtaaattccgctattttggttctttattgctatgttcggctttcctagaaaatgtgttaggcgctatcacgactgattgagattttgtatcgtgactgataattacacggtttagtaaattttgatattttcaaaaagagtttttttaataaaatatgcaacttcagtcaaaacatacaacgttttgttgtataaatccgatcaaaacatataacttacataaaacttgcgtatgaattttttgttgtataaacatttggttaaaacatataacttacatataatttgcatacaacttacataaaacttgcatataaacaatttatttatgtctttgtttttgagtatcaatttgaaattccaacaaaaacaaactctaatttttaccaaactctctcaaaattgagttatagatttcaaaagatatccttaatcgtttgcaattgtaacaatccgatcggccgttttgagatctagcgtgttgtttggcggtttgagaccttgagtaacttcactttatgttgtatgacttgtatatgtggtcggaattaaatttcgggaagttcagagttgattcggatgaaaaattctaatttcggaagttttaagatggaatgattgactaaggattgacgtttgagtaaacgatctcggaatcgagatttgaaggttccaataggttcgtatgatgatttcagacttgagcgtatgtttgggttgagtatcgggtggtccgggagcatttcaacgctgattatagaaaattggcatcttaaaggttttagaatttcataagtttggtttgaagtggattttgatattatcggtgtccatttggagtttcgagccttggaataggttcgtatcgtaaattttgactttagtgtaaagttcggcgtcattccggagtgttttgataagattctgatgcgttcgtcgaagtttggaagtttgaaagttgaaaagaagatttttaataggcgattcatgattttgatgttatttgtgtcgagcctttggataagtttgtgtgaggtatgggacttgttggtatgaatggacgagctctacgggggcctcgagtaagtttcgga

SEQ ID NO: 5 - DNA, 1554 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaa

SEQ ID NO: 6 - protein, 517 aa, Nicotiana tabacum; identical to SEQ ID NO: 3

SEQ ID NO: 7 - DNA, 998 bp, Nicotiana tabacum
gtaagttcatctgtcatttttcatttattcacttttattttgaggagcagacatgttaataataatttggagcaactgtaaagttatctatgtgtacaggttcgagcctcaggtgcaaccactaatgcttgtattagattatgttgtctgcatcatacccctaattggagtgtggctcttcccgaaccctgcaatgctggatgctggatgctttatgtatcagactgacctttttgttaaactatctaaatactaaggatgatttaataaaaatatagaatggtaaacagaaaaagatgagattatttttggggctatatggattcgcccgggctttgggaggtaaaacggtatctaccagttgagactttactccagaactttatctcgagagctctgaataaaaatgaaatagtatttaccactccaaaatctttgatggtaaaaagatgagatataacctcttataattgattgaaccacgttgatagaataaaacttctttactcccattcagcataagaaaaatgaaaccaaacggaattcttctcttttttagggggaaattccttaattgcttgttgaatatagattcatgtcgttattctatttttaataatgatgaaaatcaatatagtcaaagttaatacttatgtcatttggtttgcggacaagttatattggaactatataatacgtctattatagaatagtgattatttagaggatatacattttttttggataaatatttgatttattggattaaaaatagaatatacaggtaaggtctaaaacgtgtgtttgcttttacactaaataaacttgacctcgtacaattctaagaaaatatttgaaataaatgaattattttattgttaatcaattaaaaaaatcatagtatagatgagatgtgtgcatacttgacaataactatactaactaaaacaaggtatgtgaataattgatattccttttttaattattcttttttccag

SEQ ID NO: 8 - DNA, 2009 bp, Nicotiana tabacum
tctctaaagtccccttccactttatcttagctgtgtgatttctttcagacaaccttatttttattcagactcttatttgtattattctagaagctcgtgtacttgtgacaccagttctgggatggtatttagatatcgctattattttggcttattcacttcagttcagattttattccagttatttgatttctttattattaatcaaattgaattgttaaaaatggttaaaattactccaatgttggctttcctagtaagcgaaatatcaggcgccatcacggtacccgaaggtgagaatttcagatcgtgacagccgcatctcaaggggtgtgatgtaaacagtttacgatggtgcaagcattagtggctgcttcgacgacttaaatccgtaacttatagatcacacgaatacaactttactattttaacacccagcaaattcctgataaaaacaattctaacatagcacatcaaaatgtaaatgattgaagaaaaagatgacttttatagacagagaaaaaaacagttacgtgtggggttgaatagagattgtggctatgctatttctaatattgaaattcaccgacttttttagttcaatacgaaaagagtaagtgaaaaggtctgaaaaggaaaaggacaatgcctaaaaggacacattcagaacacatacactgaatgattctaatttctagtccgaagatttctagttcgaggataacgtgagcaatcggttacttcccattagcaattgccaactggatgtttgactatttatgtttctggccaatagaggagaggaatactacgttacgtatggagtttgaacccttcacatcaacttattaagtgagttatccctcaatcacgattcaactatgattccgctaacttcaaagaatattgagttaattattcaaatgattagtccaaaattatttaataaagttatactatttcttttatttgtaacatacatcttttgtttacatatttagttaaatcttagcccaaccctatcgttggttcgactttttttcttttaattttgatttattctgttcggtaatttcgctttgtttggcttgaataataactagtgcataaagtcatatactctaatatttttaattgaagtactcacaaatacaaaaataaaaaacattctaagctcacatgatagttgacaaaatctttatccaaaacaagaggcggagccaggatttgaaacttatgggttcagaattctaaatctcttaagttactaggttctaaattaataatttatacatgttcaatgaatttcttaagacaaatacatagtttgaacgaaagctactgggttcggccgaatccgtaagttatactctccctccgccccggtccaaaaccagctagtatcaatagagagagagagagagagagagagataataaatttgaccattgacaatggcttattacttgcttagagttaattggtgaacttagagaatataataaggaatatttaaacagatacgtcatcaatccacgagtaacgaagtaagaaataccctaaaatcgtagaaacattacgttaaattgcttgacagcctatctagtaagagtcaaaatctactatctatcttgttccgccattttcttaaagaagtacatgagctttatcatccacctcaacatgaatgcaaaagaaaattattgtgcaacttaatatgttataatcaatgatatgtgtcttgtgtaacaaagtatatatttcgatacgatattaatatgtaggtgttatatttttaaatatcaaatatcatacttaacaccgattttttaaaaacttaggccaattaccctaccaactaaaatactgtatatcaaacactaatgttttctatttcggtacgacagttctctatttaccatattatggaattatgcccatcctacagttacctataaaaaggaagttgccgatagttatattctcaacttcttatctaaaaatccata

SEQ ID NO: 9 - DNA, 1786 bp, Nicotiana tabacum
aacctaagatctttcatcttggttgatcattgtataatactcctaaatggatattcatttaccttttatcaattaattgtcagtacgagtttttctaatttggtacatttgtaataataagtaaagaataattgtgctaatatataaaggtttgtagaagataattgactggttgtaccacaatctccagtgaaagtgttaattatttacttgatccacagcttattctatgtttgaaatttgcctagtgtcatgatattactccatcaaattcaagaaataatcatttccaacttttgctggactggacgatctttcaataataaaggatctttaatttgccaaagttgagatcaaaatactggtcgctttaccaataagaatgaaatgtgatggaaattatgtacgttgggataagggaacacaactatcaaggagactaaaaggtacgtaaaggaaaagaaaaaatttgccattgattgctactaagtaacctaacaaaatctttcagaaaagaatcacttgtataagtcggggttgaaagttttggtgtctcttttcttatgtattgttgtctttagacagtattgtacttagttatttcagaattttattttcgtattagagctcaagactctgtatttattagttctgggagaattatcatgtattttcagtcttttgttatttctgtaaattccgctattttggttctttattgctatgttcggctttcctagaaaatgtgttaggcgctatcacgactgattgagattttgtatcgtgactgataattacacggtttagtaaattttgatattttcaaaaagagtttttttaataaaatatgcaacttcagtcaaaacatacaacgttttgttgtataaatccgatcaaaacatataacttacataaaacttgcgtatgaattttttgttgtataaacatttggttaaaacatataacttacatataatttgcatacaacttacataaaacttgcatataaacaatttatttatgtctttgtttttgagtatcaatttgaaattccaacaaaaacaaactctaatttttaccaaactctctcaaaattgagttatagatttcaaaagatatccttaatcgtttgcaattgtaacaatccgatcggccgttttgagatctagcgtgttgtttggcggtttgagaccttgagtaacttcactttatgttgtatgacttgtatatgtggtcggaattaaatttcgggaagttcagagttgattcggatgaaaaattctaatttcggaagttttaagatggaatgattgactaaggattgacgtttgagtaaacgatctcggaatcgagatttgaaggttccaataggttcgtatgatgatttcagacttgagcgtatgtttgggttgagtatcgggtggtccgggagcatttcaacgctgattatagaaaattggcatcttaaaggttttagaatttcataagtttggtttgaagtggattttgatattatcggtgtccatttggagtttcgagccttggaataggttcgtatcgtaaattttgactttagtgtaaagttcggcgtcattccggagtgttttgataagattctgatgcgttcgtcgaagtttggaagtttgaaagttgaaaagaagatttttaataggcgattcatgattttgatgttatttgtgtcgagcctttggataagtttgtgtgaggtatgggacttgttggtatgaatggacgagctctacgggggcctcgagtaagtttcgga

SEQ ID NO: 10 - DNA, 207 bp, Nicotiana tabacum
gcacaacttgctatcaacttggtcacatctatgttgggtcatttgttgcatcattttacatgggctccggccccgggggttaacccggaggatattgacttggaggagagccctggaacagtaacttacatgaaaaatccaatacaagctattccaactccaagattgcctgcacacttgtatggacgtgtgccagtggatatgtaa

SEQ ID NO: 11 - protein, 68 aa, Nicotiana tabacum
AQLAINLVTSMLGHLLHHFTWAPAPGVNPEDIDLEESPGTVTYMKNPIQAIPTPRLPAHLYGRVPVDM

SEQ ID NO: 12 - DNA, 207 bp, Nicotiana tabacum
gcacaacttgctatcaacttggtcacatctatgttgggtcatttgttgcatcattttacgtgggctccgcccccgggggttaacccggagaatattgacttggaggagagccctggaacagtaacttacatgaaaaatccaatacaagctattcctactccaagattgcctgcacacttgtatggacgtgtgccagtggatatgtaa

SEQ ID NO: 13 - protein, 68 aa, Nicotiana tabacum
AQLAINLVTSMLGHLLHHFTWAPPPGVNPENIDLEESPGTVTYMKNPIQAIPTPRLPAHLYGRVPVDM

SEQ ID NO: 14 - DNA, 183 bp, Nicotiana tabacum
atgaattattcattgcaagtggaacacctttcaattgctcatatgatccaaggtttcagttttgcaactacgaccaatgagcctttggatatgaaacaaggtgtgggtttaactttaccaaagaagactgatgttgaagtgctaattacacctcgccttcctcctacgctttatcaatattaa

SEQ ID NO: 15 - protein, 60 aa, Nicotiana tabacum
MNYSLQVEHLSIAHMIQGFSFATTTNEPLDMKQGVGLTLPKKTDVEVLITPRLPPTLYQY

SEQ ID NO: 16 - DNA, 132 bp, Nicotiana tabacum
gcacaacttgctatcaacttggtcacatctatgttgggtcatttgttcatcattttacatgggctccggccccgggggttaacccggaggatattgacttggaggagagccctggaacagtaacttacatga

SEQ ID NO: 17 - protein, 40 aa, Nicotiana tabacum
AQLAINLVTSMLGHLFIILHGLRPRGLTRRILTWRRALEQ

SEQ ID NO: 18 - DNA, 189 bp, Nicotiana tabacum
gaaggattggctgttcgaatggttgccttgtcattgggatgtattattcaatgttttgattggcaacgaatcggcgaagaattggttgatatgactgaaggaactggacttactttgcctaaagctcaacctttggtggccaagtgtagcccacgacctaaaatggctaatcttctctctcagatttga

SEQ ID NO: 19 - protein, 62 aa, Nicotiana tabacum
EGLAVRMVALSLGCIIQCFDWQRIGEELVDMTEGTGLTLPKAQPLVAKCSPRPKMANLLSQI

SEQ ID NO: 20 - DNA, 189 bp, Nicotiana tabacum
gaaggattggctattcgaatggttgcattgtcattgggatgtattattcaatgctttgattggcaacgacttggggaaggattggttgataagactgaaggaactggacttactttgcctaaagctcaacctttagtggccaagtgtagcccacgacctataatggctaatcttctttctcagatttga

SEQ ID NO: 21 - protein, 62 aa, Nicotiana tabacum
EGLAIRMVALSLGCIIQCFDWQRLGEGLVDKTEGTGLTLPKAQPLVAKCSPRPIMANLLSQI

SEQ ID NO: 22 - DNA, 183 bp, Nicotiana tabacum
ataggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttattttga

SEQ ID NO: 23 - protein, 60 aa, Nicotiana tabacum
IGFATLVTHLTFGRLLQGFDFSKPSNTPIDMTEGVGVTLPKVNQVEVLITPRLPSKLYLF

SEQ ID NO: 24 - DNA, 178 bp, Nicotiana tabacum
ataggctttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttat

SEQ ID NO: 25 - protein, 59 aa, Nicotiana tabacum
IGFATLVTHLTFGRLLQGFDFSKPSNTPIDMTEGVGVTLPKVNQVEVLITPRLPSKLYL

SEQ ID NO: 26 - DNA, 183 bp, Nicotiana tabacum
ataaattttgcgactttagtgacacatctgacttttggtcgcttgcttcaaggttttgattttagtacgccatcaaacacgccaatagacatgacagaaggcgtaggcgttactttgcctaaggtaaatcaagtggaagttctaattagccctcgtttaccttctaagctttatgtattctga

SEQ ID NO: 27 - protein, 60 aa, Nicotiana tabacum
INFATLVTHLTFGRLLQGFDFSTPSNTPIDMTEGVGVTLPKVNQVEVLISPRLPSKLYVF

SEQ ID NO: 28 - DNA, 171 bp, Nicotiana tabacum
attatacttgcattgccaattcttggcatcactttgggacgtttggttcagaactttgagctgttgcctcctccaggccagtcgaagctcgacaccacagagaaaggtggacagttcagtctccacattttgaagcattccaccattgtgttgaaaccaaggtctttctga

SEQ ID NO: 29 - protein, 56 aa, Nicotiana tabacum
IILALPILGITLGRLVQNFELLPPPGQSKLDTTEKGGQFSLHILKHSTIVLKPRSF

SEQ ID NO: 30 - DNA, 171 bp, Nicotiana tabacum
attatacttgcattgccaattcttggcattactttgggacgtttggttcagaactttgagctgttgcctcctccaggccagtcgaagctcgacaccacagagaaaggtggacagttcagtctccatattttgaagcattccaccattgtgttgaaaccaaggtcttgctga

SEQ ID NO: 31 - protein, 56 aa, Nicotiana tabacum
IILALPILGITLGRLVQNFELLPPPGQSKLDTTEKGGQFSLHILKHSTIVLKPRSC

SEQ ID NO: 32 - DNA, 172 bp, Nicotiana tabacum
tattgcacttggggttgcatcaatggaacttgcattgtcaaatcttctttatgcatttgattgggagttaccttttggaatgaaaaaagaagacattgacacaaacgccaggcctggaattaccatgcataagaaaaacgaactttatcttatccctaaaaattatctatag

SEQ ID NO: 33 - protein, 63 aa, Nicotiana tabacum
IALGVASMELALSNLLYAFDWELPFGMKKEDIDTNARPGITMHKKNELYLIPKNYLPSKLYLF

SEQ ID NO: 34 - DNA, 171 bp, Nicotiana tabacum
attgcacttggggttgcatccatggaacttgctttgtcaaatcttctttatgcatttgattgggagttaccttacggagtgaaaaaagaaaacattgacacaaatgtcaggcctggaattaccatgcataagaaaaacgaactttgccttatccctagaaattatctatag

SEQ ID NO: 35 - protein, 56 aa, Nicotiana tabacum
IALGVASMELALSNLLYAFDWELPYGVKKENIDTNVRPGITMHKKNELCLIPRNYL

SEQ ID NO: 36 - DNA, 174 bp, Nicotiana tabacum
ggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaattatttataa

SEQ ID NO: 37 - protein, 56 aa, Nicotiana tabacum
IALGVASMELALSNLLYAFDWELPYGVKKEDIDTNVRPGIAMHKKNELCLVPKNYL

SEQ ID NO: 38 - DNA, 201 bp, Nicotiana tabacum
attgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaaattatttataaattatattgggacgtggatctcatgctag

SEQ ID NO: 39 - protein, 66 aa, Nicotiana tabacum
IALGVASMELALSNLLYAFDWELPYGVKKEDIDTNVRPGIAMHKKNELCLVPKKLFINYIGTWISC

SEQ ID NO: 40 - DNA, 183 bp, Nicotiana tabacum
atttcgtttggtttagctaatgcttatttgccattggctcaattactttatcactttgattgggaactccccactggaatcaaaccaagcgacttggacttgactgagttggttggagtaactgccgctagaaaaagtgacctttacttggttgcgactccttatcaacctcctcaaaactga

SEQ ID NO: 41 - protein, 60 aa, Nicotiana tabacum
ISFGLANAYLPLAQLLYHFDWELPTGIKPSDLDLTELVGVTAARKSDLYLVATPYQPPQN

SEQ ID NO: 42 - DNA, 183 bp, Nicotiana tabacum
atttcgtttggcttagctaatgcttatttgccattggctcaattactatatcacttcgattggaaactccctgctggaatcgaaccaagcgacttggacttgactgagttggttggagtaactgccgctagaaaaagtgacctttacttggttgcgactccttatcaacctcctcaaaagtga

SEQ ID NO: 43 - protein, 60 aa, Nicotiana tabacum
ISFGLANAYLPLAQLLYHFDWKLPAGIEPSDLDLTELVGVTAARKSDLYLVATPYQPPQK

SEQ ID NO: 44 - DNA, 220 bp, Nicotiana tabacum
atgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaattccagtctatatcatctatatgtactcaataattgtatggga

SEQ ID NO: 45 - protein, 58 aa, Nicotiana tabacum
MLFGLANVGQPLAQLLYHFDWKLPNGQSHENFDMTESPGISATRKDDLVLIATPYDSY

SEQ ID NO: 46 - DNA, 174 bp, Nicotiana tabacum
atgctatttggtttagctaatgttggacaacctttagctcagttactttatcacttcgattggaaactccctaatggacaaactcaccaaaatttcgacatgactgagtcacctggaatttctgctacaagaaaggatgatcttattttgattgccactcctgctcattcttga

SEQ ID NO: 47 - protein, 57 aa, Nicotiana tabacum
MLFGLANVGQPLAQLLYHFDWKLPNGQTHQNFDMTESPGISATRKDDLILIATPAHS

SEQ ID NO: 48 - DNA, 177 bp, Nicotiana tabacum
ttattattcggtttagttaatgtaggacatcctttagctcaattgctttatcacttcgattggaagactcttcctgggataagttcagatagtttcgacatgactgaaacagatggagtaactgccggaagaaaggatgatctttgtttaattgctactccttttggtctcaattaa

SEQ ID NO: 49 - protein, 58 aa, Nicotiana tabacum
LLFGLVNVGHPLAQLLYHFDWKTLPGISSDSFDMTETDGVTAGRKDDLCLIATPFGLN

SEQ ID NO: 50 - DNA, 180 bp, Nicotiana tabacum
atgtcgtttggtttagttaacactgggcatcctttagctcagttgctctatttctttgactggaaattccctcataaggttaatgcagctgattttcacactactgaaacaagtagagtttttgcagcaagcaaagatgacctctacttgattccaacaaatcacatggagcaagagtag

SEQ ID NO: 51 - protein, 59 aa, Nicotiana tabacum
MSFGLVNTGHPLAQLLYFFDWKFPHKVNAADFHTTETSRVFAASKDDLYLIPTNHMEQE

SEQ ID NO: 52 - DNA, 180 bp, Nicotiana tabacum
atgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatag

SEQ ID NO: 53 - protein, 59 aa, Nicotiana tabacum
MSFGLVNTGHPLAQLLYCFDWKLPDKVNANDFRTTETSRVFAASKDDLYLIPTNHREQE

SEQ ID NO: 54 - DNA, 183 bp, Nicotiana tabacum
atgcaatttggtttggctcttgttactctgccattggctcatttgcttcacaattttgattggaaacttcccgaaggaattaatgcaagggatttggacatgacagaggcaaatgggatatctgctagaagagaaaaagatctttacttgattgctactccttatgtatcacctcttgattaa

SEQ ID NO: 55 - protein, 60 aa, Nicotiana tabacum
MQFGLALVTLPLAHLLHNFDWKLPEGINARDLDMTEANGISARREKDLYLIATPYVSPLD

SEQ ID NO: 56 - DNA, 177 bp, Nicotiana tabacum
atgacttatgcattgcaagtggaacacctaacaatggcacatttgatccagggtttcaattacagaactccaactgatgagcccttggatatgaaagaaggtgcaggcataactatacgtaaggtaaatcctgtgaaagtgataattacgcctcgcttggcacctgagctttattaa

SEQ ID NO: 57 - protein, 58 aa, Nicotiana tabacum
MTYALQVEHLTMAHLIQGFNYRTPTDEPLDMKEGAGITIRKVNPVKVIITPRLAPELY

SEQ ID NO: 58 - DNA, 177 bp, Nicotiana tabacum
atgacttatgcattgcaagtggaacacctaacaatggcacatttaatccagggtttcaattacaaaactccaaatgacgaggccttggatatgaaggaaggtgcaggcataactatacgtaaggtaaatcctgtggaactgataatagcgcctcgcctggcacctgagctttattaa

SEQ ID NO: 59 - protein, 58 aa, Nicotiana tabacum
MTYALQVEHLTMAHLIQGFNYKTPNDEALDMKEGAGITIRKVNPVELIIAPRLAPELY

SEQ ID NO: 60 - DNA, 177 bp, Nicotiana tabacum
atgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttactaa

SEQ ID NO: 61 - protein, 58 aa, Nicotiana tabacum
MTYALQVEHLTMAHLIQGFNYKTPNDEALDMKEGAGITIRKVNPVELIITPRLAPELY

SEQ ID NO: 62 - DNA, 177 bp, Nicotiana tabacum; identical to SEQ ID NO: 1

SEQ ID NO: 63 - protein, 58 aa, Nicotiana tabacum; identical to SEQ ID NO: 2

SEQ ID NO: 64 - DNA, 174 bp, Nicotiana tabacum
atgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcccctggcacctgagctttattaa

SEQ ID NO: 65 - protein, 57 aa, Nicotiana tabacum
MTYALQVEHLTMAHLIQGFNYRTPNDEPLDMKEGAGITIRKVNPVELIIAPLAPELY

SEQ ID NO: 66 - DNA, 177 bp, Nicotiana tabacum
atgacttatgcattgcaagtggaacacttaacaatggcacatttgatccaaggtttcaattacagaactccaaatgacgagcccttggatatgaaggaaggtgcaggcataactatacgtaaggtaaatcctgcggaactgataatagcgcctcgcctggcacctgagctttattaa

SEQ ID NO: 67 - protein, 58 aa, Nicotiana tabacum
MTYALQVEHLTMAHLIQGFNYRTPNDEPLDMKEGAGITIRKVNPAELIIAPRLAPELY

SEQ ID NO: 68 - DNA, 177 bp, Nicotiana tabacum
atgacttatgcattacaagtggaacacctaacaatagcacatttgatccagggtttcaattacaaaactccaaatgacgagcccttggatatgaaggaaggtgcaggattaaccatacgtaaagtaaatcctgtagaagtgacaactacggctcgcctggcacctgagctttattaa

SEQ ID NO: 69 - protein, 58 aa, Nicotiana tabacum
MTYALQVEHLTIAHLIQGFNYKTPNDEPLDMKEGAGLTIRKVNPVEVTTTARLAPELY

SEQ ID NO: 70 - DNA, 177 bp, Nicotiana tabacum
atgacttatgcattacaagtggaacacctaacaatagcacatttgatccagggtttcaattacaaaactccaaatgacgagcccttggatatgaaggaaggtgcaggattaactatacgtaaagtaaatcctgtagaagtgacaattacggctcgcctggcacctgagctttattaa

SEQ ID NO: 71 - protein, 58 aa, Nicotiana tabacum
MTYALQVEHLTIAHLIQGFNYKTPNDEPLDMKEGAGLTIRKVNPVEVTITARLAPELY

SEQ ID NO: 72 - DNA, 177 bp, Nicotiana tabacum
atgacttatgcattacaagtggaacacctaacaatagcacatttgatccagggtttcaattacaaaactccaaatgacgagcccctggatatgaaggaaggtgcaggattaactatacgtaaagtaaatcctgtagaagtgacaattacggctcgcctggcacctgagctttattaa

SEQ ID NO: 73 - protein, 58 aa, Nicotiana tabacum; identical to SEQ ID NO: 71

SEQ ID NO: 74 - DNA, 198 bp, Nicotiana tabacum
tatagccttggacttaaggttatccgagtaacattagccaacatgttgcatggattcaactggaaattacctgaaggtatgaagccagaagatataagtgtggaagaacattatgggctcactacacatcctaagtttcctgttcctgtgatcttggaatctagactttcttcagatctctattcccccatcacttaa

SEQ ID NO: 75 - protein, 65 aa, Nicotiana tabacum
YSLGLKVIRVTLANMLHGFNWKLPEGMKPEDISVEEHYGLTTHPKFPVPVILESRLSSDLYSPIT

SEQ ID NO: 76 - DNA, 190 bp, Nicotiana tabacum
atacagtcttgggattcgtataattagggcaactttagctaacttgttgcatggattcaactggagattgcctaatggtatgagtccagaagacattagcatggaagagatttatgggctaattacacaccccaaagtcgcacttgacgtgatgatggagcctcgacttcccaaccatctttacaaatag

SEQ ID NO: 77 - protein, 62 aa, Nicotiana tabacum
YSLGIRIIRATLANLLHGFNWRLPNGMSPEDISMEEIYGLITHPKVALDVMMEPRLPNHLYK

SEQ ID NO: 78 - DNA, 174 bp, Nicotiana tabacum
attaatttttcaataccacttgttgagcttgcacttgctaatctattgtttcattataattggtcacttcctgaagggatgctagctaaggatgttgatatggaagaagctttggggattaccatgcacaagaaatctcccctttgcttagtagcttctcattatacttgttga

SEQ ID NO: 79 - protein, 57 aa, Nicotiana tabacum
INFSIPLVELALANLLFHYNWSLPEGMLAKDVDMEEALGITMHKKSPLCLVASHYTC

SEQ ID NO: 80 - DNA, 190 bp, Nicotiana tabacum
atgcaacttgggctttatgcattggaaatggctgtggcccatcttcttcattgttttacttgggaattgccagatggtatgaaaccaagtgagcttaaaatggatgatatttttggactcactgctccaaaagctaatcgactcgtggctgtgcctactccacgtttgttgtgtcccctttattaattga

SEQ ID NO: 81 - protein, 61 aa, Nicotiana tabacum
MQLGLYALEMAVAHLLHCFTWELPDGMKPSELKMDDIFGLTAPKANRLVAVPTPRLLCPLY

SEQ ID NO: 82 - DNA, 186 bp, Nicotiana tabacum
atgcaacttgggctttatgcattagaaatggcagtggcccatcttcttctttgctttacttgggaattgccagatggtatgaaaccaagtgagcttaaaatggatgatatttttggactcactgctccaagagctaatcgactcgtggctgtgcctagtccacgtttgttgtgcccactttattaa

SEQ ID NO: 83 - protein, 61 aa, Nicotiana tabacum
MQLGLYALEMAVAHLLLCFTWELPDGMKPSELKMDDIFGLTAPRANRLVAVPSPRLLCPLY

SEQ ID NO: 84 - DNA, 186 bp, Nicotiana tabacum
atgcaacttgggctttatgcattggaaatggctgtggcccatcttcttcattgttttacttgggaattgccagatggtatgaaaccaagtgagcttaaaatggatgatatttttggactcactgctccaagagctaatcgactcgtggctgtgcctactccacgtttgttgtgtcccctttattaa

SEQ ID NO: 85 - protein, 61 aa, Nicotiana tabacum
MQLGLYALEMAVAHLLHCFTWELPDGMKPSELKMDDIFGLTAPRANRLVAVPTPRLLCPLY

SEQ ID NO: 86 - DNA, 93 bp, Nicotiana tabacum
atgctttggagtgcgagtatagtgcgcgtcagctacctaacttgtatttatagattccaagtatatgctgggtctgtgttcagagtagcatga

SEQ ID NO: 87 - protein, 30 aa, Nicotiana tabacum
MLWSASIVRVSYLTCIYRFQVYAGSVFRVA

SEQ ID NO: 88 - DNA, 93 bp, Nicotiana tabacum; identical to SEQ ID NO: 86

SEQ ID NO: 89 - protein, 30 aa, Nicotiana tabacum; identical to SEQ ID NO: 87

SEQ ID NO: 90 - DNA, 93 bp, Nicotiana tabacum
atgctttggagtgcgagtatagtgcgcgtcagctacctaacctgtatttatagattccaagtatatgctgggtctgtgttcagagtagcatga

SEQ ID NO: 91 - protein, 30 aa, Nicotiana tabacum; identical to SEQ ID NO: 87

SEQ ID NO: 92 - DNA, 177 bp, Nicotiana tabacum
attaatttttcaataccacttgttgagcttgcacttgctaatctattgtttcattataattggtcacttcctgaggggatgctacctaaggatgttgatatggaagaagctttggggattaccatgcacaagaaatctcccctttgcttagtagcttctcattataacttgttgtga

SEQ ID NO: 93 - protein, 58 aa, Nicotiana tabacum
INFSIPLVELALANLLFHYNWSLPEGMLPKDVDMEEALGITMHKKSPLCLVASHYNLL

SEQ ID NO: 94 - DNA, 183 bp, Nicotiana tabacum
atatcatttggtttggctaatgtttatttgccactagctcaattgttatatcattttgattggaaactccctactggaatcaattcaagtgacttggacatgactgagtcgtcaggagtaacttgtgctagaaagagtgatttatacttgactgctactccatatcaactttctcaagagtga

SEQ ID NO: 95 - protein, 61 aa, Nicotiana tabacum
GISFGLANVYLPLAQLLYHFDWKLPTGINSSDLDMTESSGVTCARKSDLYLTATPYQLSQE

SEQ ID NO: 96 - DNA, 93 bp, Nicotiana tabacum
atgctttggagtgcgagtatagtgcgcgtcagctacctaacttgtatttatagattccaagtatatgctgggtctgtgtccagagtagcatga

SEQ ID NO: 97 - protein, 30 aa, Nicotiana tabacum
MLWSASIVRVSYLTCIYRFQVYAGSVSRVA

SEQ ID NO: 98 - DNA, 153 bp, Nicotiana tabacum
ctgaattttgcaatgttagaggcaaaaatggcacttgcattgattctacaacactatgcttttgagctctctccatcttatgcacatgctcctcatacaattatcactctgcaacctcaacatggtgctcctttgattttgcgcaagctgtag

SEQ ID NO: 99 - protein, 50 aa, Nicotiana tabacum
LNFAMLEAKMALALILQHYAFELSPSYAHAPHTIITLQPQHGAPLILRKL

SEQ ID NO: 100 - DNA, 153 bp, Nicotiana tabacum
ctgaattttgcaatgttagaggcaaaaatggcacttgcattgattctacaacactatgcttttgagctctctccatcttatgcacacgctcctcatacaattatcactctgcaacctcaacatggtgctcctttgattttgcgcaagctgtag

SEQ ID NO: 101 - protein, 50 aa, Nicotiana tabacum; identical to SEQ ID NO: 99

SEQ ID NO: 102 - DNA, 226 bp, Nicotiana tabacum
aataattttgcaatgttggaaactaagattgccttagcaatgatcctacagcgttttgctttcgagctttctccatcttacgctcatgcacctacttatgtcgtcactcttcgacctcagtgtggtgctcacttaatcttgcaaaaattataggtccttaatctggatttcccattattgagtagtgcctaataaatcttctctatcactatttttccatctttca

SEQ ID NO: 103 - protein, 50 aa, Nicotiana tabacum
NNFAMLETKIALAMILQRFAFELSPSYAHAPTYVVTLRPQCGAHLILQKL

SEQ ID NO: 104 - DNA, 268 bp, Nicotiana tabacum
agcgaaggggtggcaaaggcaacaaaggggaaaatgacatattttccatttggtgcaggaccgcgaaaatgcattgggcaaaacttcgcgattttggaagcaaaaatggctatagctatgattctacaacgcttctccttcgagctctccccatcttatacacactctccatacactgtggtcactttgaaacccaaatatggtgctcccctaataatgcacaggctgtagtcctgtgagaatatgctatccgaggaattcagttcct

SEQ ID NO: 105 - protein, 50 aa, Nicotiana tabacum
QNFAILEAKMAIAMILQRFSFELSPSYTHSPYTVVTLKPKYGAPLIMHRL

SEQ ID NO: 106 - DNA, 237 bp, Nicotiana tabacum
agcgaaggggtggcaaaggcaacaaaggggaaaatgacatattttccatttggtgcaggaccgcgaaaatgcattgggcaaaacttcgcgattttggaagcaaaaatggctatagctatgattctacaacgcttctccttcgagctctctccatcttatacacactctccatacactgtggtcactttgaaacccaaatatggtgctcccctaataatgcacaggctgtagtcctgt

SEQ ID NO: 107 - protein, 50 aa, Nicotiana tabacum; identical to SEQ ID NO: 105

SEQ ID NO: 108 - DNA, 152 bp, Nicotiana tabacum
caaaattttgccatgttagaagcaaagatggctctgtctatgatcctgcaacgcttctcttttgaactgtctccgtcttatgcacatgcccctcagtccatattaaccgtcagccacaatatggtgctccacttattttccacaagctataa

SEQ ID NO: 109 - protein, 50 aa, Nicotiana tabacum
QNFAMLEAKMALSMILQRFSFELSPSYAHAPQSILTVQPQYGAPLIFHKL

SEQ ID NO: 110 - DNA, 153 bp, Nicotiana tabacum
ataaactttgcaatgacagaagcgaagatggctatggctatgattctgcaacgcttctcctttgagctatctccatcttacacacatgctccacagtctgtaataactatgcaaccccaatatggtgctcctcttatattgcacaaattgtaa

SEQ ID NO: 111 - protein, 50 aa, Nicotiana tabacum
INFAMTEAKMAMAMILQRFSFELSPSYTHAPQSVITMQPQYGAPLILHKL

SEQ ID NO: 112 - DNA, 153 bp, Nicotiana tabacum
ataaactttgcaatggcagaagcgaagatggctatggctatgattctgcaacgcttctcctttgagctatctccatcttacacacatgctccacagtctgtaataactatgcaaccccaatatggtgctcctcttatattgcacaaattgtaa

SEQ ID NO: 113 - protein, 50 aa, Nicotiana tabacum
INFAMAEAKMAMAMILQRFSFELSPSYTHAPQSVITMQPQYGAPLILHKL

SEQ ID NO: 114 - DNA, 153 bp, Nicotiana tabacum
caaaactttgcaatgatggaagcaaaaatggcagtagctatgatactacaaaaattttcctttgaactatccccttcttatacacatgctccatttgcaattgtgactattcatcctcagtatggtgctcctctgcttatgcgcagactttaa

SEQ ID NO: 115 - protein, 50 aa, Nicotiana tabacum
QNFAMMEAKMAVAMILQKFSFELSPSYTHAPFAIVTIHPQYGAPLLMRRL

SEQ ID NO: 116 - DNA, 153 bp, Nicotiana tabacum
caaaactttgcaatgatggaagcaaaaatggcagtagctatgatactacataaattttcctttgaactatccccttcttatacacatgctccatttgcaattgtgactattcatcctcagtatggtgctcctctgcttatgcgcagactttaa

SEQ ID NO: 117 - protein, 49 aa, Nicotiana tabacum
QNFAMMEAKMAVAMILHKFSFELPSYTHAPFAIVTIHPQYGAPLLMRRL

SEQ ID NO: 118 - DNA, 150 bp, Nicotiana tabacum
caaaattttgctatgttagaggctaaaatggcaatggctatgattctgaaaacctatgcatttgaactctctccatcttatgctcatgctcctcatccactactacttcaacctcaatatggtgctcaattaattttgtacaagttgtag

SEQ ID NO: 119 - protein, 49 aa, Nicotiana tabacum
QNFAMLEAKMAMAMILKTYAFELSPSYAHAPHPLLLQPQYGAQLILYKL

SEQ ID NO: 120 - DNA, 192 bp, Nicotiana tabacum
tatagcatggggctcaaggcgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttga

SEQ ID NO: 121 - protein, 63 aa, Nicotiana tabacum
YSMGLKAIQASLANLLHGFNWSLPDNMTPEDLNMDEIFGLSTPKKFPLATVIEPRLSPKLYSV

SEQ ID NO: 122 - DNA, 192 bp, Nicotiana tabacum
tatagcttggggctcaaggagattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttga

SEQ ID NO: 123 - protein, 63 aa, Nicotiana tabacum
YSLGLKEIQASLANLLHGFNWSLPDNMTPEDLNMDEIFGLSTPKKFPLATVIEPRLSPKLYSV

SEQ ID NO: 124 - DNA, 192 bp, Nicotiana tabacum
catagcttggggctcaaggtgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttga

SEQ ID NO: 125 - protein, 63 aa, Nicotiana tabacum
HSLGLKVIQASLANLLHGFNWSLPDNMTPEDLNMDEIFGLSTPKKFPLATVIEPRLSPKLYSV

SEQ ID NO: 126 - DNA, 96 bp, Nicotiana tabacum
ctgtgctttccatgtttaatctctagttatatactggctttgaatgtgaatctgtatcataatttcttgcaaatttctccttccatttcttattaa

SEQ ID NO: 127 - protein, 31 aa, Nicotiana tabacum
LCFPCLISSYILALNVNLYHNFLQISPSISY

SEQ ID NO: 128 - DNA, 192 bp, Nicotiana tabacum
tctggacttgctcaatgtgtggttggtttagctttagcaactctagtgcagtgttttgagtggaaaagggtaagcgaagaggtggttgatttgacggaaggaaaaggtctcactatgccaaaacccgagccactcatggctaggtgcgaagctcgtgacatttttcacaaagttctttcagaaatatcttaa

SEQ ID NO: 129 - protein, 63 aa, Nicotiana tabacum
SGLAQCVVGLALATLVQCFEWKRVSEEVVDLTEGKGLTMPKPEPLMARCEARDIFHKVLSEIS

SEQ ID NO: 130 - DNA, 174 bp, Nicotiana tabacum
ttgggcttggcaacggtgcatgtgaatttgatgttggcccgaatgattcaagaatttgaatggtccgcttacccggaaaataggaaagtggattttactgagaaattggaatttactgtggtgatgaaaaatcctttaagagctaaggtcaagccaagaatgcaagtggtgtaa

SEQ ID NO: 131 - protein, 57 aa, Nicotiana tabacum
LGLATVHVNLMLARMIQEFEWSAYPENRKVDFTEKLEFTVVMKNPLRAKVKPRMQVV

SEQ ID NO: 132 - DNA, 171 bp, Nicotiana tabacum
tatgctttggctatgcttcatttagagtactttgtggctaatttggtttggcattttcgatgggaggctgtggagggagatgatgttgatctttcagaaaagctagaattcaccgttgtgatgaagaatccacttcgagctcgtatctgccccagagttaactctatttga

SEQ ID NO: 133 - protein, 56 aa, Nicotiana tabacum
YALAMLHLEYFVANLVWHFRWEAVEGDDVDLSEKLEFTVVMKNPLRARICPRVNSI

SEQ ID NO: 134 - DNA, 186 bp, Nicotiana tabacum
ggtcagcaagttggacttcttagaacaaccattttcatcgcctcattactgtctgaatataagctgaaacctcgctcacaccagaaacaagttgaactcaccgatttaaatccagcaagttggcttcattcgataaaaggcgaactgttagtcgatgcgattcctcgaaagaaggcggcattttaa

SEQ ID NO: 135 - protein, 61 aa, Nicotiana tabacum
GQQVGLLRTTIFIASLLSEYKLKPRSHQKQVELTDLNPASWLHSIKGELLVDAIPRKKAAF

SEQ ID NO: 136 - DNA, 171 bp, Nicotiana tabacum
atcacatttgctaagtttgtgaatgagctagcattggcaagattaatgttccattttgatttctcgctaccaaaaggagttaagcatgaggatttggacgtggaggaagctgctggaattactgttagaaggaagttcccccttttagccgtcgccactccatgctcgtga

SEQ ID NO: 137 - protein, 56 aa, Nicotiana tabacum
ITFAKFVNELALARLMFHFDFSLPKGVKHEDLDVEEAAGITVRRKFPLLAVATPCS

SEQ ID NO: 138 - DNA, 180 bp, Nicotiana tabacum
cagaggtatgctataaaccatttgatgctctttattgcgttgttcacggctctgattgatttcaagaggcacaaaacggacggctgtgatgatatcgcgtatattccaaccattgctccaaaggatgattgtaaagtgttcctttcacagaggtgcactcgattcccatctttttcatga

SEQ ID NO: 139 - protein, 59 aa, Nicotiana tabacum
QRYAINHLMLFIALFTALIDFKRHKTDGCDDIAYIPTIAPKDDCKVFLSQRCTRFPSFS

SEQ ID NO: 140 - DNA, 183 bp, Nicotiana tabacum
atgtcatttggtttagctaatctttacttaccattggctcaattactctatcactttgactggaaactcccaaccggaatcaagccaagagacttggacttgaccgaattatcgggaataactattgctagaaagggtgacctttacttaaatgctactccttatcaaccttctcgagagtaa

SEQ ID NO: 141 - protein, 60 aa, Nicotiana tabacum
MSFGLANLYLPLAQLLYHFDWKLPTGIKPRDLDLTELSGITIARKGDLYLNATPYQPSRE

SEQ ID NO: 142 - DNA, 174 bp, Nicotiana tabacum
ttgggcttggcaacggtgcatgtgaatttgatgttggcccgaacgattcaagaatttgaatggtccgcttacccggaaaataggaaagtggattttactgagaaattggaatttactgtggtgatgaaaaaccctttaagagctaaggtcaagccaagaatgcaagtggtgtaa

SEQ ID NO: 143 - protein, 57 aa, Nicotiana tabacum
LGLATVHVNLMLARTIQEFEWSAYPENRKVDFTEKLEFTVVMKNPLRAKVKPRMQVV

SEQ ID NO: 144 - DNA, 123 bp, Nicotiana tabacum
ttgggcttggcaacggtgcatgtgaatttgatgttggcccgaatgattcaagaatttgaatggtccgcttacccggaaaataggaaagtggatttactgagaaattggaatttactgtggtga

SEQ ID NO: 145 - protein, 40 aa, Nicotiana tabacum
LGLATVHVNLMLARMIQEFEWSAYPENRKVDLLRNWNLLW

SEQ ID NO: 146 - DNA, 171 bp, Nicotiana tabacum
atcacatttgctaagtttgtgaatgagctagcattggcaagattaatgttccattttgatttctcgctaccaaaaggagttaagcatgaggatttggacgtggaggaagctgctggaattactgttaggaggaagttcccccttttagccgtcgccactccatgctcgtga

SEQ ID NO: 147 - protein, 56 aa, Nicotiana tabacum; identical to SEQ ID NO: 137

SEQ ID NO: 148 - DNA, 171 bp, Nicotiana tabacum
atcacatttgctaagtttgtgaatgagctagcattggcaagattaatgttccattttgatttctcgctaccaaaaggagttaagcatgcggatttggacgtggaggaagctgctggaattactgttagaaggaagttcccccttttagccgtcgccactccatgctcgtga

SEQ ID NO: 149 - protein, 56 aa, Nicotiana tabacum
ITFAKFVNELALARLMFHFDFSLPKGVKHADLDVEEAAGITVRRKFPLLAVATPCS

SEQ ID NO: 150 - DNA, 153 bp, Nicotiana tabacum
caaaattttgccatgttagaagcaaagactactttggctatgatcctacaacgcttctcctttgaactgtctccatcttatgcacatgctcctcagtccataataactttgcaaccccagtatggtgctccacttattttgcataaaatatag

SEQ ID NO: 151 - protein, 50 aa, Nicotiana tabacum
QNFAMLEAKTTLAMILQRFSFELSPSYAHAPQSIITLQPQYGAPLILHKI

SEQ ID NO: 152 - DNA, 171 bp, Nicotiana tabacum
attatccttgcactgccaattcttggcattaccttgggacgcttggtgcagaactttgagttgttgcctcctccaggacagtcaaagcttgacacaacagagaaaggcgggcaattcagtctgcacattttgaagcattccaccattgtgatgaaaccaagatctttttaa

SEQ ID NO: 153 - protein, 56 aa, Nicotiana tabacum
IILALPILGITLGRLVQNFELLPPPGQSKLDTTEKGGQFSLHILKHSTIVMKPRSF

SEQ ID NO: 154 - DNA, 267 bp, Nicotiana tabacum
caaaattttgccatgttagaagcaaagactactttggctatgatcctacaacgcttctcctttgaactgtctccatcttatgcacatgctcctcagtccataataacttgcaaccccagtatggtgctccacttattttgcataaaatatagtttattacttgtaagtagtgtctcgttttatgttaagcatgagtccaaaatgttaaggcttgtagaactgcaaaatgggaatgcatttgcactcgtgcactgtagattgttgtaa

SEQ ID NO: 155 - protein, 88 aa, Nicotiana tabacum
QNFAMLEAKTTLAMILQRFSFELSPSYAHAPQSIITCNPSMVLHLFCIKYSLLLVSSVSFYVKHESKMLRLVELQNGNAFALVHCRLL

SEQ ID NO: 156 - DNA, 186 bp, Nicotiana tabacum
gctgatatggggttgcgagcagtttctttggcattaggtgcacttattcaatgctttgactggcaaattgaggaagcggaaagcttggaggaaagctataattctagaatgactatgcagaacaagcctttgaaggttgtctgcactccacgcgaagatcttggccagcttctatcccaactctaa

SEQ ID NO: 157 - protein, 61 aa, Nicotiana tabacum
ADMGLRAVSLALGALIQCFDWQIEEAESLEESYNSRMTMQNKPLKVVCTPREDLGQLLSQL

SEQ ID NO: 158 - DNA, 1576 bp, Nicotiana tabacum
cttccttcctaagtcctaactaaaaatggagattcagttttctaacttagttgcattcttgctctttctctccagcatctttcttctattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcatcatatcatcacctcaaatggcaaaagaagtactaaaaactcacgacctcgcttttgccactagaccaaagcttgtcgcggccgacatcattcactacgacagcacggacatagcattttctccgtacggtgaatactggagacaaattcgtaaaatttgcatattggaactcttgagtgccaagatggtcaaattttttagctcgattcgccaagatgagctctcgaagatgctctcatctatacgaacgacacccaatcttacagtcaatcttactgacaaaattttttggtttacgagttcggtaacttgtagatcagctttagggaagatatgtggtgaccaagacaaattgatcatttttatgagggaaataatatcattggcaggtggatttagtattgctgattttttccctacatggaaaatgattcatgatattgatggttcgaaatctaaactggtgaaagcacatcgtaagattgatgaaattttgggaaatgttgttgatgagcacaaaaagaacagagcagatggcaagaagggtaatggtgaatttggtggtgaagatttgattgatgtattgttaagagttagagaaagtggagaagttcaaattcctatcacaaatgacaatatcaaatcaatattaatcgacatgttctctgcaggatctgaaacatcatcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaa

SEQ ID NO: 159 - protein, 503 aa, Nicotiana tabacum
MEIQFSNLVAFLLFLSSIFLLFKKWKTRKLNLPPGPWKLPFIGSLHHLAVAGPLPHHGLKNLAKRYGPLMHLQLGQIPTLIISSPQMAKEVLKTHDLAFATRPKLVAADIIHYDSTDIAFSPYGEYWRQIRKICILELLSAKMVKFFSSIRQDELSKMLSSIRTTPNLTVNLTDKIFWFTSSVTCRSALGKICGDQDKLIIFMREIISLAGGFSIADFFPTWKMIHDIDGSKSKLVKAHRKIDEILGNVVDEHKKNRADGKKGNGEFGGEDLIDVLLRVRESGEVQIPITNDNIKSILIDMFSAGSETSSTTIIWALAEMMKKPSVLAKAQAEVRQALKEKKGFQQIDLDELKYLKLVIKETLRMHPPIPLLVPRECMEDTKIDGYNIPFKTRVIVNAWAIGRDPESWDDPESFMPERFENSSIDFLGNHHQFIPFGAGRRICPGMLFGLANVGQPLAQLLYHFDWKLPNGQSHENFDMTESPGISATRKDDLVLIATPYDSY

SEQ ID NO: 160 - DNA, 1581 bp, Nicotiana tabacum
tccttcttccttcctaagtcctaactaaaaatggagattcagttttctaacttagttgcattcttgctctttctctccagcatctttcttctattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcatcatatcatcacctcaaatggcaaaagaagtactaaaaactcacgacctcgcttttgccactagaccaaagcttgtcgtggccgacatcattcactacgacagcacggacatagcattttctccgtacggtgaatactggagacaaattcgtaaaatttgcatattggaactcttgagtgccaagatggtcaaattttttagctcgattcgccaagatgagctctcgaagatgctctcatctatacgaacgacacccaatcttacagtcaatcttactgacaaaattttttggtttacgagttcggtaacttgtagatcagctttagggaagatatgtggtgaccaagacaaattgatcatttttatgagggaaataatatcattggcaggtggatttagtattgctgattttttccctacatggaaaatgattcatgatattgatggttcgaaatctaaactggtgaaagcacatcgtaagattgatgaaattttgggaaatgttgttgatgagcacaaaaagaacagagcagatggcaagaagggtaatggtgaatttggtggtgaagatttgattgatgtattgttaagagttagagaaagtggagaagttcaaattcctatcacaaatgacaatatcaaatcaatattaatcgacatgttctctgcgggatctgaaacatcatcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaa

SEQ ID NO: 161 - protein, 503 aa, Nicotiana tabacum
MEIQFSNLVAFLLFLSSIFLLFKKWKTRKLNLPPGPWKLPFIGSLHHLAVAGPLPHHGLKNLAKRYGPLMHLQLGQIPTLIISSPQMAKEVLKTHDLAFATRPKLVVADIIHYDSTDIAFSPYGEYWRQIRKICILELLSAKMVKFFSSIRQDELSKMLSSIRTTPNLTVNLTDKIFWFTSSVTCRSALGKICGDQDKLIIFMREIISLAGGFSIADFFPTWKMIHDIDGSKSKLVKAHRKIDEILGNVVDEHKKNRADGKKGNGEFGGEDLIDVLLRVRESGEVQIPITNDNIKSILIDMFSAGSETSSTTIIWALAEMMKKPSVLAKAQAEVRQALKEKKGFQQIDLDELKYLKLVIKETLRMHPPIPLLVPRECMEDTKIDGYNIPFKTRVIVNAWAIGRDPESWDDPESFMPERFENSSIDFLGNHHQFIPFGAGRRICPGMLFGLANVGQPLAQLLYHFDWKLPNGQSHENFDMTESPGISATRKDDLVLIATPYDSY

SEQ ID NO: 162 - DNA, 1538 bp, Nicotiana tabacum
caactgcagtttgaagataccaactaaccaaaatgcagttcttcagcttggtttccattttcctatttctatcttttctctttttgttaaggaaatggaagaactcgaatagccaaaggaaaaaattgccaccaggtccatggaaactaccaatactaggaagtatgcttcatatggttggtggactaccacaccatgtccttagagatttagccaaaaaatatggaccgcttatgcaccttcaattaggtgaagtttctgcagttgtggttacttctcctgatatggcaaaagaagtactaaaaactcatgacatcgctttcgcgtctaggcctagccttttggccccggagattgtctgttacaataggtctgatcttgcgttttgcccctatggcgattattggagacaaatgcgtaaaatatgtgtcttggaagtgctcagtgccaagaatgttcggacatatagctctattaggcgcgatgaagttcttcgtctccttaattttatccggtcatcttctggtgagcctgttaatattacggaaaggatctttttgttcacaagctccatgacatgtagatcagcgtttgggcaagtattcaaggagcaagacaaatttatacaactaattaaagaagttatactcttagcaggagggtttgatgtggctgacatattcccttcatacaagtctcttcatgtgctcagtggaatgaagggtaagattatgaatgcacaccataaggtagatgctattgttgagaatgtcatcaacgagcacaagaaaaatcttgcaattgggaaaactaatggagcgttaggaggtgaagatttaattgatgttcttctaaaacttatgaatgatggaggccttcaatttcctatcaccaacgacaacatcaaagctataatctttgacatgtttgctgctggaacagagacttcatcgtcaacaattgtgtgggctatggtggaaatggtgaaaaatccaactgtatttgcgaaagctcaagcagaagtaagagatgcatttagagaaaaagaaacttttgatgaaaatgatgtggaggagctaaactatctaaagttagtcattaaagaaactctaagacttcatccaccggttccacttttgctcccaagagaatgtagggaagagacaaatataaacggctacactattcctgtaaagaccaaagtcatggttaatgtttgggcattgggaagagatccaaaatattgggatgatgcagaaacttttaagccagagagatttgagcagtgctctaaggattttgttggtaataattttgaatatcttccatttggtggtggaaggaggatttgtccagggatttcgtttggtttagctaatgcttatttgccattggctcaattactttatcactttgattgggaactccccactggaatcaaaccaagcgacttggacttgactgagttggttggagtaactgccgctagaaaaagtgacctttacttggttgcgactccttatcaacctcctcaaaac

SEQ ID NO: 163 - protein, 502 aa, Nicotiana tabacum
MQFFSLVSIFLFLSFLFLLRKWKNSNSQRKKLPPGPWKLPILGSMLHMVGGLPHHVLRDLAKKYGPLMHLQLGEVSAVVVTSPDMAKEVLKTHDIAFASRPSLLAPEIVCYNRSDLAFCPYGDYWRQMRKICVLEVLSAKNVRTYSSIRRDEVLRLLNFIRSSSGEPVNITERIFLFTSSMTCRSAFGQVFKEQDKFIQLIKEVILLAGGFDVADIFPSYKSLHVLSGMKGKIMNAHHKVDAIVENVINEHKKNLAIGKTNGALGGEDLIDVLLKLMNDGGLQFPITNDNIKAIIFDMFAAGTETSSSTIVWAMVEMVKNPTVFAKAQAEVRDAFREKETFDENDVEELNYLKLVIKETLRLHPPVPLLLPRECREETNINGYTIPVKTKVMVNVWALGRDPKYWDDAETFKPERFEQCSKDFVGNNFEYLPFGGGRRICPGISFGLANAYLPLAQLLYHFDWELPTGIKPSDLDLTELVGVTAARKSDLYLVATPYQPPQN

SEQ ID NO: 164 - DNA, 1530 bp, Nicotiana tabacum
aaaagatgtcttcattttccacatcttctgccacttctaattccaaacttccagttcgagaaatcccaggagactatggtttccccttttttggagccataaaagatagatatgactacttctacaacctcggcacagacgaattctttcttaccaaaatgcaaaaatacaactctactgtctttagaaccaacatgccaccaggtccattcattgctaaaaatcccaaagtaattgttctcctcgatgccaaaacatttcccgttcttttcgacaactctaaagtcgaaaaaatgaacgttcttgatggcacgtacgtgccatctactgatttctatggcggatatcgcccgtgtgcttatcttgatccttctgagtcaactcatgccacacttaaagggttctttttatctttaatctcccagcttcataatcaatttattcctttatttagaacctcaatttctggtcttttcgcaaatcttgagaatgagatttcccaaaatggcaaagcgaacttcaacaatatcagcgacattatgtcattcgattttgtttttcgtttgttatgtgacaagaccagtccccatgacacaaatcttggctctaatggaccaaaactctttgatatatggctgttgcctcaacttgctccattgtttagtctaggtctaaaatttgtgccgaactttctggaagatttaatgttgcatacttttcccttgccattttttctagtgagatcgaattaccagaagctttatgatgcttttagcaagcatgccgaaagtacactgaatgaagcagagaagaatgggatcaaaagagacgaagcatgccacaacttagtttttcttgcaggtttcaatgcttatggtgggatgaaagttttattccctgcactgataaagtgggtcgccaatggaggaaagagtttacacactcggctggcaaatgaaatcaggacaattatcaaagaagaatgtgggaccataactctatcagcaatcaacaagatgagtttagtaaaatcagtagtgtatgaagtattaagaattgaacctccagttccattccaatatggtaaagccaaagaagatatcataatccaaagccatgattcaactttcttagtcaagaaaggtgaaatgatctttggatatcagccttttgctacaaaagatccaaagatttttgacaaaccagaggagtttattccggagaggttcatggccgaaggggaaaaattattaaagtatgtgtattggtcaaatgcaagagagacagatgatccaacggtggacaacaaacaatgcccagcgaaaaatcttgtcgtgcttttgtgcaggttgatgttggtggaggttttcatgcgttacgacacattcacagtggagtcaacaaagctctttcttgggtcatcagtaacgttcacgactctggaaaaagcgacatgagtttcagatatcttaattgtaggctgcaaataataatgtggtcattctgcaaattattgtacttgtgctgatg

SEQ ID NO: 165 - protein, 483 aa, Nicotiana tabacum
MSSFSTSSATSNSKLPVREIPGDYGFPFFGAIKDRYDYFYNLGTDEFFLTKMQKYNSTVFRTNMPPGPFIAKNPKVIVLLDAKTFPVLFDNSKVEKMNVLDGTYVPSTDFYGGYRPCAYLDPSESTHATLKGFFLSLISQLHNQFIPLFRTSISGLFANLENEISQNGKANFNNISDIMSFDFVFRLLCDKTSPHDTNLGSNGPKLFDIWLLPQLAPLFSLGLKFVPNFLEDLMLHTFPLPFFLVRSNYQKLYDAFSKHAESTLNEAEKNGIKRDEACHNLVFLAGFNAYGGMKVLFPALIKWVANGGKSLHTRLANEIRTIIKEECGTITLSAINKMSLVKSVVYEVLRIEPPVPFQYGKAKEDIIIQSHDSTFLVKKGEMIFGYQPFATKDPKIFDKPEEFIPERFMAEGEKLLKYVYWSNARETDDPTVDNKQCPAKNLVVLLCRLMLVEVFMRYDTFTVESTKLFLGSSVTFTTLEKAT

SEQ ID NO: 166 - DNA, 1593 bp, Nicotiana tabacum
ccaaaaatggagcttcaatcttctcctttcaatttaatttctttgttcctcttcttttcttttcattttattctagtgaagaaatggaatgccaaaatcccaaagttacctccaggtccgtggaggcttccctttattggaagcctccatcacttgaagggaaaacttccacaccataatcttagagatctagcgcgaaaatatgggcctctcatgtacttacaactcggagaaattcctgtagttgtaatatcttcgccacgtgtagcaaaagctgtactaaaaactcatgatctcgcttttgcaactagaccacgattcatgtcctcagacattgtgttttacaaaagcagggacatctcttttgccccatttggtgattactggagacagatgcgtaaaatattgactcaggaactcctgagtaacaagatgctcaagtcatatagcttaatccgaaaggatgagctctcgaagctcctctcatcgattcgtttggaaacaggttctgcagtgaacataaatgaaaagcttctctggtttacgagctgcatgacctgtagattagcctttggaaaaatatgcaatgatcgggatgagttgatcatgctaattagggagatattaacattatcaggaggatttgatgtgggtgatttgttcccttcctggaaattacttcataatatgagcaacatgaaagctaggttgacgaatgtacaccacaagtatgatttagttatggagaacatcatcaatgagcaccaagagaatcatgcagcagggataaagggtaacaacgagtttggtggcgaagatatgatcgatgctctactgagggctaaggagaataatgagcttcaatttcctatcgaaaatgacaacatgaaagcagtaattctggacttgtttattgctggaactgaaacttcatatactgcaattatatgggcactatcagaattgatgaagcacccaagtgtgatggccaaggcacaagctgaagtgagaaaagtcttcaaagaaaatgaaaatttcgacgaaaatgatcttgacaagttgccatacttaaaatcagtgattaaagaaacactaaggatgcaccctccagttcctttgttagggcctagagaatgcagggaccaaacagagatcgatggctacactgtacctattaaagctagagttatggttaatgcttgggcgataggaagagatcctgaaagttgggaagatcctgaaagtttcaaaccggagcgatttgaaaatacttctgttgatcttacaggaaatcactatcagttcattcctttcggttcaggaagaagaatgtgtccaggaatgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatagcttaatttaatggagttcttggaagaattaaagaagaagggctatataggtgagattttttgtatggttgca

SEQ ID NO: 167 - protein, 504 aa, Nicotiana tabacum
MELQSSPFNLISLFLFFSFHFILVKKWNAKIPKLPPGPWRLPFIGSLHHLKGKLPHHNLRDLARKYGPLMYLQLGEIPVVVISSPRVAKAVLKTHDLAFATRPRFMSSDIVFYKSRDISFAPFGDYWRQMRKILTQELLSNKMLKSYSLIRKDELSKLLSSIRLETGSAVNINEKLLWFTSCMTCRLAFGKICNDRDELIMLIREILTLSGGFDVGDLFPSWKLLHNMSNMKARLTNVHHKYDLVMENIINEHQENHAAGIKGNNEFGGEDMIDALLRAKENNELQFPIENDNMKAVILDLFIAGTETSYTAIIWALSELMKHPSVMAKAQAEVRKVFKENENFDENDLDKLPYLKSVIKETLRMHPPVPLLGPRECRDQTEIDGYTVPIKARVMVNAWAIGRDPESWEDPESFKPERFENTSVDLTGNHYQFIPFGSGRRMCPGMSFGLVNTGHPLAQLLYCFDWKLPDKVNANDFRTTETSRVFAASKDDLYLIPTNHREQE

SEQ ID NO: 168 - DNA, 1599 bp, Nicotiana tabacum
cttcttccaaaaatggagcttcaatcttctcctttcaatttaatttctttgttcctcttcttttcttttctttttattctagtgaagaaatggaatgccaaaatcccaaagttacctccaggtccgtggaggcttccctttattggaagcctccatcacttgaagggaaaacttccacaccataatcttagagatctagcgcgaaaatatggacctctcatgtacttacaactcggagaaattcctgtagttgtaatatcttcgccacgtgtagcaaaagctgtactaaaaactcatgatctcgcttttgcaactagaccacgattcatgtcctcagacattgtgttttacaaaagcagggacatctcttttgccccatttggtgattactggagacagatgcgtaaaatattgactcaggaactcctgagtaacaagatgctcaagtcatatagcttaatccgaaaggatgagctctcgaagctcctctcatcgattcgtttggaaacaggttctgcagtgaacataaatgaaaagcttctctggtttacgagctgcatgacctgtagattagcctttggaaaaatatgcaatgatcgggatgagttgatcatgctaattagggagatattaacattatcaggaggatttgatgtgggtgatttgttcccttcctggaaattacttcataatatgagcaacatgaaagctaggttgacgaatgtacaccacaagtatgatttagttatggagaacatcatcaatgagcaccaagagaatcatgcagcagggataaagggtaacaacgagtttggtggcgaagatatgatcgatgctctactgagggctaaggagaataatgagcttcaatttcctatcgaaaatgacaacatgaaagcagtaattctggacttgtttattgctggaactgaaacttcatatactgcaattatatgggcactatcagaattgatgaagcacccaagtgtgatggccaaggcacaagctgaagtgagaaaagtcttcaaagaaaatgaaaatttcgacgaaaatgatcttgacaagttgccatacttaaaatcagtgattaaagaaacactaaggatgcaccctccagttcctttgttagggcctagagaatgcagggaccaaacagagatcgatggctacactgtacctattaaagctagagttatggttaatgcttgggcgataggaagagatcctgaaagttgggaagatcctgaaagtttcaaaccggagcgatttgaaaatacttctgttgatcttacaggaaatcactatcagttcattcctttcggttcaggaagaagaatgtgtccaggaatgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatagcttaatttaatggagttcttggaagaattaaagaagaagggctatataggtgagattttttgtatggttgca

SEQ ID NO: 169 - protein, 504 aa, Nicotiana tabacum
MELQSSPFNLISLFLFFSFLFILVKKWNAKIPKLPPGPWRLPFIGSLHHLKGKLPHHNLRDLARKYGPLMYLQLGEIPVVVISSPRVAKAVLKTHDLAFATRPRFMSSDIVFYKSRDISFAPFGDYWRQMRKILTQELLSNKMLKSYSLIRKDELSKLLSSIRLETGSAVNINEKLLWFTSCMTCRLAFGKICNDRDELIMLIREILTLSGGFDVGDLFPSWKLLHNMSNMKARLTNVHHKYDLVMENIINEHQENHAAGIKGNNEFGGEDMIDALLRAKENNELQFPIENDNMKAVILDLFIAGTETSYTAIIWALSELMKHPSVMAKAQAEVRKVFKENENFDENDLDKLPYLKSVIKETLRMHPPVPLLGPRECRDQTEIDGYTVPIKARVMVNAWAIGRDPESWEDPESFKPERFENTSVDLTGNHYQFIPFGSGRRMCPGMSFGLVNTGHPLAQLLYCFDWKLPDKVNANDFRTTETSRVFAASKDDLYLIPTNHREQE

SEQ ID NO: 170 - DNA, 1564 bp, Nicotiana tabacum
ctttctttcttgtaccgagatggagtttcaacacttggtttcgttcttgctattcatctccttcatctttcttctaattcaaaaatggaggaaatcgaaaaagctgccacctggtccgtggaggctacctattattggaagtgtgcatcacttgacaagtggagtaccacatcgagttctcagaaatttatcacaaaaatttggcccgatcatgtacttgcagctcggggaagttcccacagtagttgtatcctccccacacatggccaaacaaattttaaaaactcatgacctcgcttttgcatctaggccagaaatcatgatgggaaaaattatttgctacgattgtaaggacattgccttttccccgtatggtgattattggagacatatgcgtaaattgagcaccttggaactacttagtgccaagatggtcaagtccttcagtccaattcgtcaagatgagctctcaagtctcctatcatccattgaatcaatgggaaatttgccaatcaacttagtagaaaaacttttatggtttatgaatgccgcgacatgtaggtcagcatttgggaaagtgtgtaaagatcaaaaagagttgataacattgattcaacgagcagaatcattatctggtggattcgagctggctgatttgttcccttcgaagaagtttctacatggtattagtgggatgcgatctaaactaatggaagctcgtaacaagatagacgcagtcttggacaacattatcaatgtgcacagagagaatcgggcaaatggaaatagttgtaatggtgagtctggaactgtagatttcatcgatgtttttctaagggtcatggagagtggcgaattaccatttccgatagaaaatgacaacatcaaagcagttattcttgacatgttcgtagcaggatctgacacatcatcttcaaccgttatttgggcattaacagaaatgatgaagaatccaaaagtcatggctaaagcacaagctgaagtgagagaagcttttaaaggaaagaaagcatgtgatgaggatactgatcttgaaaagcttcattacctaaatttagtgatcaaagagacactccgattacaccctccaactcctctacttgtcccgcgagaatgcagggaggaaacagagatagaaggattcactataccattgaaaagcaaagtcttggttaacgtatgggcaattggaagagatcccgagaattggaaaaatcctgaatgttttataccagagagattcgaaaatagttctattgagtttactggaaatcattttcaacttcttccgtttggcgctggaagacgaatttgtccaggaatgcaatttggtttggctcttgttactctgccattggctcatttgcttcacaattttgattggaaacttcccgaaggaattaatgcaagggatttggacatgacagaggcaaatgggatatctgctagaagagaaaaagatctttacttgattgctactccttatgtatcacctcttgattaactctgaaattttgctttaatgctgcttgcttgcttcact

SEQ ID NO: 171 - protein, 501 aa, Nicotiana tabacum
MEFQHLVSFLLFISFIFLLIQKWRKSKKLPPGPWRLPIIGSVHHLTSGVPHRVLRNLSQKFGPIMYLQLGEVPTVVVSSPHMAKQILKTHDLAFASRPEIMMGKIICYDCKDIAFSPYGDYWRHMRKLSTLELLSAKMVKSFSPIRQDELSSLLSSIESMGNLPINLVEKLLWFMNAATCRSAFGKVCKDQKELITLIQRAESLSGGFELADLFPSKKFLHGISGMRSKLMEARNKIDAVLDNIINVHRENRANGNSCNGESGTVDFIDVFLRVMESGELPFPIENDNIKAVILDMFVAGSDTSSSTVIWALTEMMKNPKVMAKAQAEVREAFKGKKACDEDTDLEKLHYLNLVIKETLRLHPPTPLLVPRECREETEIEGFTIPLKSKVLVNVWAIGRDPENWKNPECFIPERFENSSIEFTGNHFQLLPFGAGRRICPGMQFGLALVTLPLAHLLHNFDWKLPEGINARDLDMTEANGISARREKDLYLIATPYVSPLD

SEQ ID NO: 172 - DNA, 1560 bp, Nicotiana tabacum
ctttcttgtaccgagatggagtttcaacacttggtttcgttcttgctattcatctccttcatctttcttctaattcaaaaatggaggaaatcgaaaaagctgccacctggtccgtggaggctacctattattggaagtgtgcatcacttgacaagtggagtaccacatcgagttctcagaaatttatcacaaaaatttggcccgatcatgtacttgcagctcggggaagttcccacagtagttgtatcctccccacacatggccaaacaaattttaaaaactcatgacctcgcttttgcatctaggccagaaatcatgatgggaaaaattatttgctacgattgtaaggacattgccttttccccgtatggtgattattggagacatatgcgtaaattgagcaccttggaactacttagtgccaagatggtcaagtccttcagtccaattcgtcaagatgagctctcaagtctcctatcatccattgaatcaatgggaaatttgccaatcaacttagtagaaaaacttttatggtttatgaatgccgcgacatgtaggtcagcatttgggaaagtgtgtaaagatcaaaaagagttgataacattgattcaacgagcagaatcattatctggtggattcgagctggctgatttgttcccttcgaagaagtttctacatggtattagtgggatgcgatctaaactaatggaagctcgtaacaagatagacgcagtcttggacaacattatcaatgtgcacagagagaatcgggcaaatggaaatagttgtaatggtgagtctggaactgtagatttcatcgatgtttttctaagggtcatggagagtggcgaattaccatttccgatagaaaatgacaacatcaaagcagttattcttgacatgttcgtagcaggatctgacacatcatcttcaaccgttatttgggcattaacagaaacgatgaagaatccaaaagtcatggctaaagcacaagctgaagtgagagaagcttttaaaggaaagaaagcatgtgatgaggatactgatcttgaaaagcatcattacctaaatttagtgatcaaagagacactccgattacaccctccaactcctctacttgtcccgcgagaatgcagggaggaaacagagatagaaggattcactataccattgaaaagcaaagtcttggttaacgtatgggcaattggaagagatcccgagaattggaaaaatcctgaatgttttataccagagagattcgaaaatagttctattgagtttactggaaatcattttcaacttcttccgtttggcgctggaagacgaatttgtccaggaatgcaatttggtttggctcttgttactctgccattggctcatttgcttcacaattttgattggaaacttcccgaaggaattaatgcaagggatttggacatgacagaggcaaatgggatatctgctagaagagaaaaagatctttacttgattgctactccttatgtatcacctcttgattaactctgaaattttgctttaatgctgcttgcttgcttcact

SEQ ID NO: 173 - protein, 501 aa, Nicotiana tabacum
MEFQHLVSFLLFISFIFLLIQKWRKSKKLPPGPWRLPIIGSVHHLTSGVPHRVLRNLSQKFGPIMYLQLGEVPTVVVSSPHMAKQILKTHDLAFASRPEIMMGKIICYDCKDIAFSPYGDYWRHMRKLSTLELLSAKMVKSFSPIRQDELSSLLSSIESMGNLPINLVEKLLWFMNAATCRSAFGKVCKDQKELITLIQRAESLSGGFELADLFPSKKFLHGISGMRSKLMEARNKIDAVLDNIINVHRENRANGNSCNGESGTVDFIDVFLRVMESGELPFPIENDNIKAVILDMFVAGSDTSSSTVIWALTETMKNPKVMAKAQAEVREAFKGKKACDEDTDLEKHHYLNLVIKETLRLHPPTPLLVPRECREETEIEGFTIPLKSKVLVNVWAIGRDPENWKNPECFIPERFENSSIEFTGNHFQLLPFGAGRRICPGMQFGLALVTLPLAHLLHNFDWKLPEGINARDLDMTEANGISARREKDLYLIATPYVSPLD

SEQ ID NO: 174 - DNA, 1552 bp, Nicotiana tabacum
caaaaacaaaattccaatggttaacatgttcactccaattatatacgctcctctccttttagctttttacattatcacaaaacatttcttacgcaaactcagaaataatccaccagctccatttcttactttcccctttattggccatctttatctcttcaaaaaaccacttcaacgtaccttagccaaaatctccgaacgttatggctctgttcttctactcgaattcggttcacgaaaagtacttttggtttcttcaccatctgcagctgaagaatgcttaacaaaaaacgatattattttcgcgaatcgtcctcttttgatggctggaaaacatcttggatataattttacatctttggcttggagttcgtacggagatcattggagaaatctgcgaaggattacttcagttgagatgttttcgactcatcgtcttcaaatgctacatgggattcgtattgatgaagtgaaatctatggttaagaggctcaattcctctgccatagctgaaaaatctgtggatatgaagtctatgttttttgagctgatgctcaatgttatgatgaggacaattgctggaaaaagatattacggtgagaatgtggaggacattgaggaagctacgagattcaaaggtttggtgcaagagactttcaggattggcggggcgacgaatattggcgactttttgccggcgttgaagttattggtgaggaaattggagaaaagtttaattgtgttgcaagagaacagagatgagtttatgcaggaattaattaaagattgcagaaaaagaatggagaaagaaggtactgttactgattcagaaattgaagggaacaagaaatgtttaattgaagttttgttaacactacaagaaaatgaaccggaatactacaaagatgaaatcatcagaagccttatgcttgttctattatcagctggtacagatacttcagttgggacaatggaatgggctttatcattaatgttaaaccaccctgaaactctgaagaaagcacaagctgaaattgatgaacatataggacatgaacgtttagtggacgagtcggacatcaacaacctaccttacctacgttgtataatcaacgagacattccgaatgtaccctgcaggaccactactagtcccacacgagtcgtcagaggaaaccaccgtaggaggctaccgtgtacccggaggaaccatgttacttgtgaatttgtgggcaattcacaatgatccaaagctatgggatgaaccaagaaagtttaaaccagaaagatttcaaggactagatggtgttagagatggttacaaaatgatgccttttggttctggacgaaggagttgtcctggagaaggattggctgttcgaatggttgccttgtcattgggatgtattattcaatgttttgattggcaacgaatcggcgaagaattggttgatatgactgaaggaactggacttactttgcctaaagctcaacctttggtggccaagtgtagcccacgacctaaaatggctaatcttctctctcagatttga

SEQ ID NO: 175 - protein, 511 aa, Nicotiana tabacum
MVNMFTPIIYAPLLLAFYIITKHFLRKLRNNPPAPFLTFPFIGHLYLFKKPLQRTLAKISERYGSVLLLEFGSRKVLLVSSPSAAEECLTKNDIIFANRPLLMAGKHLGYNFTSLAWSSYGDHWRNLRRITSVEMFSTHRLQMLHGIRIDEVKSMVKRLNSSAIAEKSVDMKSMFFELMLNVMMRTIAGKRYYGENVEDIEEATRFKGLVQETFRIGGATNIGDFLPALKLLVRKLEKSLIVLQENRDEFMQELIKDCRKRMEKEGTVTDSEIEGNKKCLIEVLLTLQENEPEYYKDEIIRSLMLVLLSAGTDTSVGTMEWALSLMLNHPETLKKAQAEIDEHIGHERLVDESDINNLPYLRCIINETFRMYPAGPLLVPHESSEETTVGGYRVPGGTMLLVNLWAIHNDPKLWDEPRKFKPERFQGLDGVRDGYKMMPFGSGRRSCPGEGLAVRMVALSLGCIIQCFDWQRIGEELVDMTEGTGLTLPKAQPLVAKCSPRPKMANLLSQI

SEQ ID NO: 176 - DNA, 1675 bp, Nicotiana tabacum
caaaaacaaaattccaatggttaacatgttcactccaattatatacgctcctctccttttagctttttacattatcacaaaacatttcttacgcaaactcagaaataacccaccagctccatttcttactttcccctttattggccatctttatctcttcaaaaaaccacttcaacgtaccttagccaaaatctccgaacgttatggctctgttcttctactcgaattcggttcacgaaaagtacttttggtttcttcaccatctgcagctgaagaatgcttaacaaaaaacgatattattttcgcgaatcgtcctcttttgatggctggaaaacatcttggatataattttacttctttggcttggagttcgtacggagatcactggagaaatcttcgtaggattacttcagttgagatgttttcgactcatcgtcttcaaatgctacatggaattcgtattgatgaagtgaaatctatggttaagaggctcaattcctctgccatagctgaaaaatctgtggatatgaagtctatgttttttgagctgatgctcaatgttatgatgaggacaattgctggaaaaagatattacggtgagaatgtggaggacattgaggaagctacgagattcaaaggtttggtgcaagagactttcaggattggcggggcgacgaatattggcgactttttgccggcgttgaagttattggtgaggaaattggagaaaagtttaattgtgttgcaagagaacagagatgagtttatgcaggaattaattaaagattgcagaaaaagaatggagaaagaaggtactgttactgattcagaaattgaagggaacaagaaatgtttaattgaagttttgttaacactacaagaaaatgaaccggaatactacaaagatgaaatcatcagaagccttatgcttgttctattatcagctggtacagatacttcagttgggacaatggaatgggctttatcattaatgttaaaccaccctgaaactctgaagaaagcacaagctgaaattgatgaacatataggacatgaacgtttagtggacgagtcggacatcaacaacctaccttacctacgttgtataatcaacgagacattccgaatgtaccctgcaggaccactactagtcccacacgagtcgtcagaggaaaccaccgtaggaggctaccgtgtacccggaggaaccatgttacttgtgaatttgtgggctattcacaatgatccaaagctatgggatgaaccaagaaagtttaagccagaaagatttgaaggactagaaggtgttagagacggttacaaaatgatgccttttggttctggacgaaggagttgtcctggagaaggattggctattcgaatggttgcattgtcattgggatgtattattcaatgctttgattggcaacgacttggggaaggattggttgataagactgaaggaactggacttactttgcctaaagctcaacctttagtggccaagtgtagcccacgacctataatggctaatcttctttctcagatttgaacataattggtttctaccaaacatccccaaactagaatattattattggttacatatacaatgtaatcaattttgaaccatattatatctcaatgtattcctttttaaaaaaaaaaaaaaaaa

SEQ ID NO: 177 - protein, 511 aa, Nicotiana tabacum
MVNMFTPIIYAPLLLAFYIITKHFLRKLRNNPPAPFLTFPFIGHLYLFKKPLQRTLAKISERYGSVLLLEFGSRKVLLVSSPSAAEECLTKNDIIFANRPLLMAGKHLGYNFTSLAWSSYGDHWRNLRRITSVEMFSTHRLQMLHGIRIDEVKSMVKRLNSSAIAEKSVDMKSMFFELMLNVMMRTIAGKRYYGENVEDIEEATRFKGLVQETFRIGGATNIGDFLPALKLLVRKLEKSLIVLQENRDEFMQELIKDCRKRMEKEGTVTDSEIEGNKKCLIEVLLTLQENEPEYYKDEIIRSLMLVLLSAGTDTSVGTMEWALSLMLNHPETLKKAQAEIDEHIGHERLVDESDINNLPYLRCIINETFRMYPAGPLLVPHESSEETTVGGYRVPGGTMLLVNLWAIHNDPKLWDEPRKFKPERFEGLEGVRDGYKMMPFGSGRRSCPGEGLAIRMVALSLGCIIQCFDWQRLGEGLVDKTEGTGLTLPKAQPLVAKCSPRPIMANLLSQI

SEQ ID NO: 178 - DNA, 1755 bp, Nicotiana tabacum
caacacgcttactatctcctaaatctccactcaaaaacaaagaagagaaagatttaaaactaataattatgaaagagatggtgcaaaacaatatgagcacttctcttcttgaaactttacaagctacgcccatgatattctacttcatcgtccctctcttctgcttattccttctctccaaatctcgccgtaaacgtttgcctccaggtccaactggctggcctctcattggtaacatgatgatgatggaccagttaactcaccgtggccttgccaaactagcccaaaaatatggtggtgtttttcaccttaaaatgggttatgttcacaaaattgtagtctctggtccagacgaagctcgccaagtattacaggaacacgacatcatattttcgaaccgtccagcgaccgtagccataagttacctaacatatgacagggcagacatggcttttgctgactatggactcttctggcggcagatgagaaaactatgtgtaatgaaactcttcagccgcaaacgagctgagtcatgggactcagttcgagacgaagcggattccatggttagaattgtaacaaccaacacaggcacagctgttaacttaggtgaacttgttttcagtctcactcgtaatattatctacagagctgcttttggaacttgttctgaagatggacaaggcgagttcattaaaattatgcaagagttttcgaagctatttggtgctttcaatatagctgattttattccatggctagggtgggttggtaagcagagtctaaatattagacttgctaaggctagagcgtcgcttgatgggttcattgattcgattattgatgaccatattattagaaagaaagcttatgttaatggcaaaaatgatggaggtgatcgagaaactgatatggtggatgagcttttagctttttacagtgaggaagcaaaagtaactgagtccgaagatttgcagaatgctatcagacttactaaggataatatcaaagctatcatcatggatgtaatgtttggagggacagaaacagtggcttctgcaatagaatgggccatggcagagcttatgaggagtcctgaagatcttaaaaaggtacaacaagagctggctaacgttgttggactcaacagaaaagttgaagaatctgactttgaaaaattaacatacttaagatgttgtctaaaagaaactctacgacttcaccctccaatccctctcctcctccatgagaccgccgaggaatccaccgtctccggctaccatattccggcaaagtcacatgttattataaattcatttgccattgggcgtgacaaaaattcatgggaagatcctgaaacttataaaccatctaggtttctcaaagaaggtgtaccagattttaaaggaggtaattttgagtttataccatttgggtcgggtcggcggtcttgccccggtatgcaacttgggctttatgcattggaaatggctgtggcccatcttcttcattgttttacttgggaattgccagatggtatgaaaccaagtgagcttaaaatggatgatatttttggactcactgctccaagagctaatcgactcgtggctgtgcctactccacgtttgttgtgtcccctttattaattgaagaaaaaaggtggggcttttacttgcatcaaagagtggtgcttgtgatttttccaccttttggttaaatatacgaattattatgatatacgaattcttgggcaca

SEQ ID NO: 179 - protein, 525 aa, Nicotiana tabacum
MKEMVQNNMSTSLLETLQATPMIFYFIVPLFCLFLLSKSRRKRLPPGPTGWPLIGNMMMMDQLTHRGLAKLAQKYGGVFHLKMGYVHKIVVSGPDEARQVLQEHDIIFSNRPATVAISYLTYDRADMAFADYGLFWRQMRKLCVMKLFSRKRAESWDSVRDEADSMVRIVTTNTGTAVNLGELVFSLTRNIIYRAAFGTCSEDGQGEFIKIMQEFSKLFGAFNIADFIPWLGWVGKQSLNIRLAKARASLDGFIDSIIDDHIIRKKAYVNGKNDGGDRETDMVDELLAFYSEEAKVTESEDLQNAIRLTKDNIKAIIMDVMFGGTETVASAIEWAMAELMRSPEDLKKVQQELANVVGLNRKVEESDFEKLTYLRCCLKETLRLHPPIPLLLHETAEESTVSGYHIPAKSHVIINSFAIGRDKNSWEDPETYKPSRFLKEGVPDFKGGNFEFIPFGSGRRSCPGMQLGLYALEMAVAHLLHCFTWELPDGMKPSELKMDDIFGLTAPRANRLVAVPTPRLLCPLY

SEQ ID NO: 180 - DNA, 1684 bp, Nicotiana tabacum
tgtgcttgtgagtgtgggagaaggccttcaatatggagataccatattacagcttaaaaattgcaatttcttcatttgcaattatctttgtactaagatgggcatggaaaatcttgaattatgtgtggttaaaaccaaaagaattggagaaatacctcagacagcagggtttcaaaggaaactcttacaaattcttgtttggggatatgaaagagatgaagaaaatgggtgaagaagctatgtctaagccaatcaatttctctcatgacatgatttggcctagagttatgccattcatccacaaaaccatcaccaattatggtaagaattgtattgtgtggtttgggccaagaccagcagtcctgatcacagacccggaacttgtaaaggaggtgctaacgaagaatttcgtctatcagaagccgcttggcaatccactcacaaagttggcagcaactggaattgcaggctatgaaacagataaatgggctacacatagaaggcttctcaatcctgcttttcaccttgacaagttgaagcatatgctacctgcattccaatttactgctagtgagatgttgagcaaattggagaaagttgtttcaccaaacggaacagagatagatgtgtggccatatttacaaactttgacaagtgatgccatttcaagaactgcgtttggaagtagttatgaagaaggaagaaagatttttgaccttcaaaaagaacaactttcactaattctagaagtttcacgcacaatatatattccaggatggaggtttttgccaacgaaaaggaacaaaaggatgaagcaaatatttaatgaagtacgagcactggtatttggaattattaagaaaaggatgagtatgattgaaaatggagaagcacctgatgatttattgggaatattattggcatccaatttaaaagaaatccaacaacatggaaacaacaagaaatttggtatgagtattgatgaggtgattgaagagtgtaaactcttctattttgctgggcaagagactacttcatctttacttgtatggactatgattttgttgtgcaaatatcctaattggcaagataaagctagagaagaggttttgcaagtgtttgggagtagggaagttgactatgacaagttgaatcagctaaaaatagtaactatgatcttaaacgaggtcttaaggttgtatccagcaggatatgtgattaatcgaatggtaaacaaagaaacaaagttagggaatttgtgtttaccagccggcgtacagctcgtgttaccaacaatgttgttgcaacatgatactgaaatatggggagatgatgcaatggagttcaatccagagagatttagtgatggaatatccaaagcaacaaaaggaaaacttgtgttttttccatttagttggggtccaagaatatgtattgggcaaaattttgctatgttagaggctaaaatggcaatggctatgattctgaaaacctatgcatttgaactctctccatcttatgctcatgctcctcatccactactacttcaacctcaatatggtgctcaattaattttgtacaagttgtagatatggtcaatttggaacttgttatggaacttttatcattgtaatcaaccatattgagggaacatggtttgaggttaaatcctcgtgtgtgtgtc

SEQ ID NO: 181 - protein, 518 aa, Nicotiana tabacum
MEIPYYSLKIAISSFAIIFVLRWAWKILNYVWLKPKELEKYLRQQGFKGNSYKFLFGDMKEMKKMGEEAMSKPINFSHDMIWPRVMPFIHKTITNYGKNCIVWFGPRPAVLITDPELVKEVLTKNFVYQKPLGNPLTKLAATGIAGYETDKWATHRRLLNPAFHLDKLKHMLPAFQFTASEMLSKLEKVVSPNGTEIDVWPYLQTLTSDAISRTAFGSSYEEGRKIFDLQKEQLSLILEVSRTIYIPGWRFLPTKRNKRMKQIFNEVRALVFGIIKKRMSMIENGEAPDDLLGILLASNLKEIQQHGNNKKFGMSIDEVIEECKLFYFAGQETTSSLLVWTMILLCKYPNWQDKAREEVLQVFGSREVDYDKLNQLKIVTMILNEVLRLYPAGYVINRMVNKETKLGNLCLPAGVQLVLPTMLLQHDTEIWGDDAMEFNPERFSDGISKATKGKLVFFPFSWGPRICIGQNFAMLEAKMAMAMILKTYAFELSPSYAHAPHPLLLQPQYGAQLILYKL

SEQ ID NO: 182 - DNA, 1697 bp, Nicotiana tabacum
ccagcaccaagacatggagaattcctgggtagttttagccttaacaggccttcttacattagtttttctctcaaagtttcttcatagtcctcgtcgtaaacaaaatcttccaccaggtccaaaaccatggcctattgttggcaatatacatcttcttggttccacccctcacagatcccttcacgaacttgcaaaaagatacggagatttaatgctactaaagttcggttcgcgcaatgtccttattttatcctccccagatatggctagagaattcttgaaaacaaatgatgccatttgggcttctcgccctgagcttgccgctggtaaatatactgcttataattattgcgacatgacatgggcacgttatggacccttttggagacaagcaaggaggatctatctcaacgagattttcaatcctaaacgtttggattcatttgagtacattcgcatagaggaaaggcataatttgatttcacgtctttttgttctctctgggaagccaattcttcttagagaccatttaactcggtacactcttacaagtataagtagaacagtattgagtggaaaatattttagcgagtcacctggccaaaattcaatgataactttgaaacaattgcaggatatgcttgataagtggtttttgcttaatggtgtgatcaatattggggactggataccttggcttgctttcttggatttgcagggttatgtcaagcaaatgaaggagttgcataggaacttcgacaaatttcataactttgtgctagatgatcacaaggctaataggggagagaagaactttgtgccaagagacatggtcgatgttttgctgcagcaagctgaggatcctaatcttgaggtcaaactcaccaatgattgtgtcaagggtctaatgcaggacttattggctggcggcacggacacctcagcaacaaccgttgaatgggctttttatgaacttcttagacaacctaagattatgaagaaagcacaacaagagctagaccttgtcatttcacaggacagatgggttcaagaaaaagattacactcaactcccttacattgagtcaatcatcaaggaaacattgaggcttcacccagtaagcaccatgcttccaccgcgcattgccttggaggattgtcatgtagcaggctatgacatacctaaaggtacaattttaattgtgaacacttggagtattggaagaaattcacagcattgggagtcaccagaagaattccttccggagaggtttgaagggaagaatattggtgtcacaggacaacattttgcgctcttgccatttggcgcgggccggagaaagtgcccaggatacagtcttgggattcgtataattagggcaactttagctaacttgttgcatggattcaactggagattgcctaatggtatgagtccagaagacattagcatggaagagatttatgggctaattacacaccccaaagtcgcacttgacgtgatgatggagcctcgacttcccaaccatctttacaaatagtggataattaaaaccattaaaatcgttttgttatatgcatgtctcatatttgtagtggtcaaaatgtttgttttctatcatggatgttcagtgcgaggttgggaatttcaagtcattaacgtgtgaaaatattttaaatttaaaaaaaaaaaaaaaa

SEQ ID NO: 183 - protein, 508 aa, Nicotiana tabacum
MENSWVVLALTGLLTLVFLSKFLHSPRRKQNLPPGPKPWPIVGNIHLLGSTPHRSLHELAKRYGDLMLLKFGSRNVLILSSPDMAREFLKTNDAIWASRPELAAGKYTAYNYCDMTWARYGPFWRQARRIYLNEIFNPKRLDSFEYIRIEERHNLISRLFVLSGKPILLRDHLTRYTLTSISRTVLSGKYFSESPGQNSMITLKQLQDMLDKWFLLNGVINIGDWIPWLAFLDLQGYVKQMKELHRNFDKFHNFVLDDHKANRGEKNFVPRDMVDVLLQQAEDPNLEVKLTNDCVKGLMQDLLAGGTDTSATTVEWAFYELLRQPKIMKKAQQELDLVISQDRWVQEKDYTQLPYIESIIKETLRLHPVSTMLPPRIALEDCHVAGYDIPKGTILIVNTWSIGRNSQHWESPEEFLPERFEGKNIGVTGQHFALLPFGAGRRKCPGYSLGIRIIRATLANLLHGFNWRLPNGMSPEDISMEEIYGLITHPKVALDVMMEPRLPNHLYK

SEQ ID NO: 184 - DNA, 1631 bp, Nicotiana tabacum
actgttcaaatcacagtaacagcatcttgtgctgccataataattactctagtggtgtgtatatggagagtgctgaattgggtttggttcagaccaaagaagctggaaaagctactgaggaaacaaggtctcaaaggcaattcctacaggattttgtatggggatatgaaggagctttctggtatgattaaggaagctaactccaaacccatgaatctttctgatgatattgccccaagattggtccctttctttcttgataccatcaagaaatatgggaaaaaatcctttgtatggttgggtccaaaaccgctggtttttgtcatggaccccgagcttataaaggaagtattctccaaaaactatctgtatcaaaagcctcattcaaatccattaaccaagttactggcacaaggacttgtaagccaagaggaagacaaatgggccaaacatagaaaaatcgtcactcctgccttccacctggagaagctaaagcatatgcttccagctttttgtttgagctgtactgagatgctgagcaaatgggaagacattgttgcagttgagggctcacatgagatagatatatggcctggccttcaacaattaactagtgatgtgatctctcggacagcctttggcagtagctatgaagcaggtagaaggatatttgaacttcaaaaggaacaagctcaatttcttatggaagctatacgctccgtttatattccaggctggaggtttttgccaacaaagaggaacagaagaatgaaggaaattgaaaaggatgttcaagccttagttagaggtattattgataaaagagtaaagtcaatgaaagcaggagaggtgaataatgaggatctgcttggtatattgctggaatctaattttaaagaaattgaacagcatggaaacaaggattttggaatgagcattgaagaagtcattcaagaatgcaagttattctattttgctggccaagaaactacatcagtgttgcttgtatggactctaatattgctgagcaggcatcaggattggcaagcactggccagagaagaggtgttgcaagtctttgggaatcagaaaccagattttgatggattaaatcgtctaaaaattgttacaatgatcttgtacgagtctttaaggctctatcccccagtagtgacacttacccgaaggcctaaggaagacactgtattaggagatgtatctctaccagcaggtgtgttaatctccttaccagtgatcttattgcatcacgacgaagagatatggggtaaagatgcaaagaagttcaagccagagagattcagagatggagtctcaagtgcaacaaagggtcaagtcacttttttcccatttacttggggtcccagaatatgcattggacaaaattttgccatgttagaagcaaagactactttggctatgatcctacaacgcttctcctttgaactgtctccatcttatgcacatgctcctcagtccataataactttgcaaccccagtatggtgctccacttattttgcataaaatatagtttattacttgtaagtagtgtctcgttttatgttaagcatgagtccaaaatgttaaggcttgtagaactgcaaaatggga

SEQ ID NO: 185 - protein, 461 aa, Nicotiana tabacum
MKELSGMIKEANSKPMNLSDDIAPRLVPFFLDTIKKYGKKSFVWLGPKPLVFVMDPELIKEVFSKNYLYQKPHSNPLTKLLAQGLVSQEEDKWAKHRKIVTPAFHLEKLKHMLPAFCLSCTEMLSKWEDIVAVEGSHEIDIWPGLQQLTSDVISRTAFGSSYEAGRRIFELQKEQAQFLMEAIRSVYIPGWRFLPTKRNRRMKEIEKDVQALVRGIIDKRVKSMKAGEVNNEDLLGILLESNFKEIEQHGNKDFGMSIEEVIQECKLFYFAGQETTSVLLVWTLILLSRHQDWQALAREEVLQVFGNQKPDFDGLNRLKIVTMILYESLRLYPPVVTLTRRPKEDTVLGDVSLPAGVLISLPVILLHHDEEIWGKDAKKFKPERFRDGVSSATKGQVTFFPFTWGPRICIGQNFAMLEAKTTLAMILQRFSFELSPSYAHAPQSIITLQPQYGAPLILHKI

SEQ ID NO: 186 - DNA, 1572 bp, Nicotiana tabacum
atttatctctgaaaatgcaattcttcagcttggtttccattttcctattcctatctttcctatttttgttgaggaaatggaagaactccaatagccaaagcaaaaaattgccaccaggtccatggaaaataccaatactaggaagtatgcttcatatgattggtggagaaccgcaccatgtccttagagatttagccaaaaaagatggaccacttatgcaccttcagttaggtgaaatttctgcagttgtggttacttctagggacatggcaaaagaagtgctaaaaactcatgacgtcgtttttgcatctaggcctaaaattgtagccatggacattatctgttataaccagtccgacattgcctttagcccttatggcgaccactggagacaaatgcgtaaaatttgtgtcatggaacttctcaatgcaaagaatgttcggtctttcagctccatcagacgtgatgaagtcgttcgtctcattgactctatccggtcagattcttcttcaggtgagctagttaattttacgcagaggatcatttggtttgcaagctccatgacgtgtagatcagcatttgggcaagtactcaaggggcaagacatatttgccaaaaagatcagagaagtaataggattagcagaaggctttgatgtggtagacatcttccctacatacaagtttcttcatgttctcagtgggatgaagcgtaaacttttgaatgcccaccttaaggtagacgccattgttgaggatgtcatcaacgagcacaagaaaaatcttgcagctggcaagagtaatggcgcattaggaggcgaagatctaattgatgtcctactgagacttatgaatgacacaagtcttcaatttcccatcaccaacgacaatatcaaagctgttgttgttgacatgtttgctgccggaacagaaacttcatcaacaacaactgtatgggccatggctgaaatgatgaagaatccaagtgtattcgccaaagctcaagcagaagtgcgagaagcctttagggacaaagtatcttttgatgaaaatgatgtggaggagctgaaatacttaaagttagtcattaaagaaactttgagacttcatccaccgtctccacttttggtcccaagagaatgcagggaagatacggatataaacggctacactattcctgcaaagaccaaagttatggttaatgtttgggcattgggaagagatccaaaatattgggatgacgcggaaagctttaagccagagagatttgagcaatgttctgtagatatttttggtaataattttgagtttcttccctttggcgggggacggagaatttgtcctggaatgtcatttggtttagctaatctttacttaccattggctcaattactctatcactttgactggaaactcccaaccggaatcaagccaagagacttggacttgaccgaattatcgggaataactattgctagaaagggtgacctttacttaaatgctactccttatcaaccttctcgagagtaatttactattggcataaacattttaaatttccttcatcaacctc

SEQ ID NO: 187 - protein, 504 aa, Nicotiana tabacum
MQFFSLVSIFLFLSFLFLLRKWKNSNSQSKKLPPGPWKIPILGSMLHMIGGEPHHVLRDLAKKDGPLMHLQLGEISAVVVTSRDMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDIFAKKIREVIGLAEGFDVVDIFPTYKFLHVLSGMKRKLLNAHLKVDAIVEDVINEHKKNLAAGKSNGALGGEDLIDVLLRLMNDTSLQFPITNDNIKAVVVDMFAAGTETSSTTTVWAMAEMMKNPSVFAKAQAEVREAFRDKVSFDENDVEELKYLKLVIKETLRLHPPSPLLVPRECREDTDINGYTIPAKTKVMVNVWALGRDPKYWDDAESFKPERFEQCSVDIFGNNFEFLPFGGGRRICPGMSFGLANLYLPLAQLLYHFDWKLPTGIKPRDLDLTELSGITIARKGDLYLNATPYQPSRE

SEQ ID NO: 188 - DNA, 1633 bp, Nicotiana tabacum
ataatgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttaggggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgctacgtgatcctaaactctggcctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatctttcatcttggttgatcattgtataatactcctaaatggatattcatttaccttttatcaattaa

SEQ ID NO: 189 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLGEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLLRDPKLWPDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 190 - DNA, 1585 bp, Nicotiana tabacum
aatccataatgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgcttgat

SEQ ID NO: 191 - protein, 517 aa, Nicotiana tabacum; identical to SEQ ID NO: 3

SEQ ID NO: 192 - DNA, 1620 bp, Nicotiana tabacum
ctaaaactccataatggtttctcccgtagaagccattgtaggactagtaacccttacacttctcttctacttcctatggcccaaaaaatttcaaataccttcaaaaccattaccaccgaaaattcccggagggtggccggtaatcggccatcttttctacttcgatgatgacggcgacgaccgtccattagctcgaaaactcggagacttagctgacaaatacggcccggttttcactttccggctaggccttccgcttgtgttaattgtaagcagttacgaagctgtaaaagactgcttctctacaaatgacgccattttctccaatcgtccagcttttctttacggtgaataccttggctacaataatgccatgctatttttgacaaaatacggaccttattggcgaaaaaatagaaaattagtcattcaggaagttctctctgctagtcgtctcgaaaaattgaagcacgtgagatttggtaaaattcaaacgagcattaagagtttatacactcgaattgatggaaattcgagtacgataaatctaactgattggttagaagaattgaattttggtctgatcgtgaaaatgatcgctgggaaaaattatgaatccggtaaaggagatgaacaagtggagagatttaggaaagcgtataaggattttataattttatcaatggagtttgtgttatgggatgcttttccaattccattgttcaaatgggtggattttcaaggctatgttaaggccatgaaaaggacatttaaggatatagattctgtttttcagaattggttagaggaacatgtcaagaaaagagaaaaaatggaggttaatgcacaagggaatgaacaagatttcattgatgtggtgctttcaaaaatgagtaatgaatatcttgatgaaggttactctcgtgatactgtcataaaagcaacagtgtttagtttggtcttggatgctgcggacacagttgctcttcacatgaattggggaatggcattactgataaacaatcaacatgccttgaagaaagcacaagaagagatcgataagaaagttggtaaggaaagatgggtagaagagagtgatattaaggatttggtctacctccaagctattgttaaagaagtgttacgattatatccaccaggacctttattagtacctcatgaaaatgtagaggattgtgttgttagtggatatcacattcctaaagggactagactattcgcgaacgttatgaaattgcagcgcgatcctaaactctggtcaaatcctgataagtttgatccagagagattcttcgctgatgatattgactaccgtggtcagcactatgagtttatcccatttggttctggaagacgatcttgtccggggatgacttatgcattacaagtggaacacctaacaatagcacatttgatccagggtttcaattacaaaactccaaatgacgagcccttggatatgaaggaaggtgcaggattaactatacgtaaagtaaatcctgtagaagtgacaattacggctcgcctggcacctgagctttattaaaaccttagatgttttatcttgattgtactaatatatatatgcagaaaaaattg

SEQ ID NO: 193 - protein, 517 aa, Nicotiana tabacum
MVSPVEAIVGLVTLTLLFYFLWPKKFQIPSKPLPPKIPGGWPVIGHLFYFDDDGDDRPLARKLGDLADKYGPVFTFRLGLPLVLIVSSYEAVKDCFSTNDAIFSNRPAFLYGEYLGYNNAMLFLTKYGPYWRKNRKLVIQEVLSASRLEKLKHVRFGKIQTSIKSLYTRIDGNSSTINLTDWLEELNFGLIVKMIAGKNYESGKGDEQVERFRKAYKDFIILSMEFVLWDAFPIPLFKWVDFQGYVKAMKRTFKDIDSVFQNWLEEHVKKREKMEVNAQGNEQDFIDVVLSKMSNEYLDEGYSRDTVIKATVFSLVLDAADTVALHMNWGMALLINNQHALKKAQEEIDKKVGKERWVEESDIKDLVYLQAIVKEVLRLYPPGPLLVPHENVEDCVVSGYHIPKGTRLFANVMKLQRDPKLWSNPDKFDPERFFADDIDYRGQHYEFIPFGSGRRSCPGMTYALQVEHLTIAHLIQGFNYKTPNDEPLDMKEGAGLTIRKVNPVEVTITARLAPELY

SEQ ID NO: 194 - DNA, 1623 bp, Nicotiana tabacum
cgaggctccccaccaaaaaatcatttctctcgtctaaaatggatcttctcttactagagaagaccttaattggtcttttctttgccattttaatcgctttaattgtctctaaacttcgttcaaagcgttttaagcttcctccaggaccaattccagtaccagtttttggtaattggcttcaagttggtgatgatttaaaccacagaaatcttactgattatgccaaaaaatttggcgatcttttcttgttaagaatgggtcaacgtaacttagttgttgtgtcatctcctgaattagctaaagaagttttacacacacaaggtgttgaatttggttcaagaacaagaaatgttgtgtttgatatttttactggaaaaggtcaagatatggtttttactgtatatggtgaacattggagaaaaatgaggagaattatgactgtaccattttttactaataaagttgtgcaacagtatagaggggggtgggagtttgaggtggcaagtgtaattgaggatgtgaaaaaaaatcctgaatctgctactaatgggatcgtattaaggaggagattacaattaatgatgtataataatatgtttaggattatgtttgataggagatttgagagtgaagatgatcctttgtttgttaagcttaaggctttgaatggtgaaaggagtagattggctcaaagttttgagtataattatggtgattttattccaattttgaggccttttttgagaggttatttgaagatctgtaaagaagttaaggagaagaggctgcagcttttcaaagattactttgttgatgaaagaaagaagctttcaaataccaagagctcggacagcaatgccctaaaatgtgcgattgatcacattcttgaggctcaacagaagggagagatcaatgaggacaacgttctttacattgttgaaaacatcaatgttgctgcaattgaaacaacattatggtcaattgagtggggtatcgccgagctagtcaaccaccctcacatccaaaagaaactgcgcgacgagattgacacagttcttggaccaggagtgcaagtgactgaaccagacacccacaagcttccataccttcaggctgtgatcaaggaggcacttcgtctccgtatggcaattcctctattagtcccacacatgaaccttcacgacgcaaagcttggcgggtttgatattccagcagagagcaaaatcttggttaacgcttggtggttagctaacaacccggctcattggaagaaacccgaagagttcagacccgagaggttctttgaagaggagaagcatgttgaggccaatggcaatgacttcagatatcttccgtttggcgttggtaggaggagctgccctggaattatacttgcattgccaattcttggcatcactttgggacgtttggttcagaactttgagctgttgcctcctccaggccagtcgaagctcgacaccacagagaaaggtggacagttcagtctccacattttgaagcattccaccattgtgttgaaaccaaggtctttctgaactttgtgatcttattaattaaggggttctgaagaaatttgatagtgttggatattaagggcgaatt

SEQ ID NO: 195 - protein, 505 aa, Nicotiana tabacum
MDLLLLEKTLIGLFFAILIALIVSKLRSKRFKLPPGPIPVPVFGNWLQVGDDLNHRNLTDYAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPFLRGYLKICKEVKEKRLQLFKDYFVDERKKLSNTKSSDSNALKCAIDHILEAQQKGEINEDNVLYIVENINVAAIETTLWSIEWGIAELVNHPHIQKKLRDEIDTVLGPGVQVTEPDTHKLPYLQAVIKEALRLRMAIPLLVPHMNLHDAKLGGFDIPAESKILVNAWWLANNPAHWKKPEEFRPERFFEEEKHVEANGNDFRYLPFGVGRRSCPGIILALPILGITLGRLVQNFELLPPPGQSKLDTTEKGGQFSLHILKHSTIVLKPRSF

SEQ ID NO: 196 - DNA, 1667 bp, Nicotiana tabacum
caacacgcttactatctcctaaatctccactcaaaaacaaagaagagaaagatttaaaactaataattatgaaagagatggtgcaaaacaatatgagcacttctcttcttgaaactttacaagctacgcccatgatattctacttcatcgtccctctcttctgcttattccttctctccaaatctcgccgtaaacgtttgcctccaggtccaactggctggcctctcattggtaacatgatgatgatggaccagttaactcaccgtggccttgccaaactagcccaaaaatatggtggtgtttttcaccttaaaatgggttatgttcacaaaattgtagtctctggtccagacgaagctcgccaagtattacaggaacacgacatcatattttcgaaccgtccagcgaccgtagccataagttacctaacatatgacagggcagacatggcttttgctgactatggactcttctggcggcagatgagaaaactatgtgtaatgaaactcttcagccgcaaacgagctgagtcatgggactcagttcgagacgaagcggattccatggttagaattgtaacaaccaacacaggcacagctgttaacttaggtgaacttgttttcagtctcactcgtaatattatctacagagctgcttttggaacttgttctgaagatggacaaggcgagttcattgaaattatgcaagagttttcgaagctatttggcgctttcaatatagctgattttattccatggctagggtgggttggtaagcagagtctaaatattagacttgctaaggctagagcgtcgcttgatgggttcattgattcgattattgatgaccatattattagaaagaaagcttatgttaatggcaaaaatgatggaggtgatcgagaaactgatatggtggatgagcttttagctttttacagtgaggaagcaaaagtaactgagtccgaagatttgcagaatgctatcagacttactaaggatagtatcaaagctatcatcatggatgtaatgtttggagggacagaaacagtggcttctgcaatagaatgggccatggcagagcttatgaggagtcctgaagatcttaaaaaagtacaacaagggctggctaacgttgttggactcaacagaaaagttgaagaatctgactttgaaaaattaacatacttaagatgttgtctaaaagaaactctacgacttcaccctccaatccctctcctcctccatgagaccgccgaggaatccaccgtctccggctaccatattccggcaaagtcacatgttattataaattcatttgccattgggcgtgacaaaaattcatgggaagatcctgaaacttataaaccatctaggtttctcaaagaaggtgtaccagattttaaaggaggtaattttgagtttataccatttgggtcgggtcggcggtcttgccccggtatgcaacttgggctttatgcattggaaatggctgtggcccatcttcttcattgttttacttgggaattgccagatggtatgaaaccaagtgagcttaaaatggatgatatttttggactcactgctccaagagctaatcgactcgtggctgtgcctactccacgcttgttgtgtcccctttattaattgaagaaaaaaggtggggct

SEQ ID NO: 197 - protein, 525 aa, Nicotiana tabacum
MKEMVQNNMSTSLLETLQATPMIFYFIVPLFCLFLLSKSRRKRLPPGPTGWPLIGNMMMMDQLTHRGLAKLAQKYGGVFHLKMGYVHKIVVSGPDEARQVLQEHDIIFSNRPATVAISYLTYDRADMAFADYGLFWRQMRKLCVMKLFSRKRAESWDSVRDEADSMVRIVTTNTGTAVNLGELVFSLTRNIIYRAAFGTCSEDGQGEFIEIMQEFSKLFGAFNIADFIPWLGWVGKQSLNIRLAKARASLDGFIDSIIDDHIIRKKAYVNGKNDGGDRETDMVDELLAFYSEEAKVTESEDLQNAIRLTKDSIKAIIMDVMFGGTETVASAIEWAMAELMRSPEDLKKVQQGLANVVGLNRKVEESDFEKLTYLRCCLKETLRLHPPIPLLLHETAEESTVSGYHIPAKSHVIINSFAIGRDKNSWEDPETYKPSRFLKEGVPDFKGGNFEFIPFGSGRRSCPGMQLGLYALEMAVAHLLHCFTWELPDGMKPSELKMDDIFGLTAPRANRLVAVPTPRLLCPLY

SEQ ID NO: 198 - DNA, 1620 bp, Nicotiana tabacum
gggggataagaatatggagataccatattacagcttaaaacttacaattttttcatttgcaattatctttgtactaagatgggcatggaaaatcttgaattatgtgtggttaaaaccaaaagaattggagaaatgcatcagacagcagggtttcaaaggaaactcttacaaattcttgtttggggatatgaaagagataaagaaaatgggtgaagaagctatgtctaagccaatcaatttctctcatgacatgatttggcctagagtcatgcccttcatccacaaaaccatcaccaattatggtaagaattgttttgtgtggtttgggccaagaccagcagtcctgatcacagacccggaacttgtaaaggaggtgctaacgaagaatttcgtttatcagaagccacctggcactccactcacaaaattggcagcaactggaattgcaggctatgaaacagataaatgggctacacatagaaggcttctcaatcctgcttttcaccttgacaagttgaagcatatgctacctgcattccaatttactgcttgtgagatgttgagcaaattggagaaagttgtctcaccaaatggaacagagatagatgtgtggccatatctacaaactttaacaagtgatgccatttcaagaactgcttttggcagtagttatgaagaaggaagaaagctttttgaacttcaaaaggaacaactttcactaattctagaagtgtcccgcacaatatacatcccaggatggaggtttttgccaacaaaaaggaacaaaaggatgaagcaaatatttaatgaagtacgagcgctggtattgggaattattaagaaaagattgagtatgattgaaaatggagaagctcctgatgatttattgggtatattattggcatccaatttaaaagaaatccaacaacatggaaataacaagaaatttggtatgagtattgatgaggtgattgaagagtgtaaactcttctattttgcggggcaagagacaacttcatctttacttgtatggactatgattttgttgtgcaaacatcctagttggcaagataaagctagagaagaggttttgcaagtgtttggaagtagggaagttgactatgacaagttgaatcagctaaaaatagtaactatgatcttaaacgaggtcttaaggttgtatccagcaggatatgcgattaatcgaatggtaaccaaagaaacaaagttagggaatttatgtttaccagctggggtacaactcttgttaccaacaattttgttgcaacatgatactgaaatatggggagatgatgcaatggagttcaatccagagagatttagtgatggaatatccaaagcaacaaaaggaaaacttgtgttctttccatttagttggggtccaagaatatgtattgggcaaaattttgctatgttagaggccaagatggcaatggctatgattctgaaaaactatgcatttgaactctctccatcttatgctcatgctcctcatccactactacttcaacctcaatatggtgctcaattaattttgtacaagttgtagaaatggtcaatttggaacttgttatggaacttttatcatcgtaatcaacc

SEQ ID NO: 199 - protein, 518 aa, Nicotiana tabacum
MEIPYYSLKLTIFSFAIIFVLRWAWKILNYVWLKPKELEKCIRQQGFKGNSYKFLFGDMKEIKKMGEEAMSKPINFSHDMIWPRVMPFIHKTITNYGKNCFVWFGPRPAVLITDPELVKEVLTKNFVYQKPPGTPLTKLAATGIAGYETDKWATHRRLLNPAFHLDKLKHMLPAFQFTACEMLSKLEKVVSPNGTEIDVWPYLQTLTSDAISRTAFGSSYEEGRKLFELQKEQLSLILEVSRTIYIPGWRFLPTKRNKRMKQIFNEVRALVLGIIKKRLSMIENGEAPDDLLGILLASNLKEIQQHGNNKKFGMSIDEVIEECKLFYFAGQETTSSLLVWTMILLCKHPSWQDKAREEVLQVFGSREVDYDKLNQLKIVTMILNEVLRLYPAGYAINRMVTKETKLGNLCLPAGVQLLLPTILLQHDTEIWGDDAMEFNPERFSDGISKATKGKLVFFPFSWGPRICIGQNFAMLEAKMAMAMILKNYAFELSPSYAHAPHPLLLQPQYGAQLILYKL

SEQ ID NO: 200 - DNA, 1566 bp, Nicotiana tabacum
gtcctaactaaaaatggagattcagttttctaacttagttgcattcttgctctttctctccagcatctttcttctattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcatcatatcatcacctcaaatggcaaaagaagtactaaaaactcacgacctcgcttttgccactagaccaaagcttgtcgtggccgacatcattcactacgacagcacggacatagcattttctccgtacggtgaatactggagacaaattcgtaaaatttgcatattggaactcttgagtgccaagatggtcaaattttttagctcgattcgccaagatgagctctcgaagatgctctcatctatacgaacgacacccaatcttacagtcaatcttactgacaaaattttttggtttacgagttcggtaacttgtagatcagctttagggaagatatgtggtgaccaagacaaattgatcatttttatgagggaaataatatcattggcaggtggatttagtattgctgattttttccctacatggaaaatgattcatgatattgatggttcgaaatctaaactggtgaaagcacatcgtaagattgatgaaattttgggaaatgttgttgatgagcacaaaaagaacagagcagatggcaagaagggtaatggtgaatttggtggtgaagatttgattgatgtattgttaagagttagagaaagtggagaagttcaaattcctatcacaaatgacaatatcaaatcaatattaatcgacatgttctctgcgggatctgaaacatcatcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaagt

SEQ ID NO: 201 - protein, 503 aa, Nicotiana tabacum; identical to SEQ ID NO: 161

SEQ ID NO: 202 - DNA, 1652 bp, Nicotiana tabacum
caactaacaaacacattgagtcctctcccaaatcactgattcaccaccaaaagtaccaacaattcaatggaaggtacaaacttgactacatatgcagcagtatttcttgatactctgtttcttttgttcctttccaaacttcttcgccagaggaaactcaatttacctccaggcccaaaaccatggccgatcatcggaaacttaaaccttattggcaatcttcctcatcgctcaatccacgaactctccctcaagtacggacccgttatgcaactccaattcgggtctttccccgttgtagttggatcctccgtcgaaatggctaagattttcctcaaatccatggatattaactttgtaggcaggcctaaaacggctgccggaaaatacacaacgtacaattattccgatattacatggtctccttacggaccatattggcgccaggcacgtaggatgtgcctaacggaattattcagcacgaaacgtctcgattcatacgagtatattcgggctgaggagttgcattctcttctccataatttgaacaaaatatcagggaaaccaattgtgttgaaagattattcgacgacgttgagtttaaatgttattagcaggatggtactggggaaaaggtatttggacgaatccgagaactcgttcgtgaatcctgaggaatttaagaagatgttggacgaattgtttttgctaaatggtgtacttaatattggagattcaattccatggattgatttcatggatttgcaaggttatgttaagaggatgaaagtagtgagcaagaaattcgacaagtttttagagcatgttattgatgagcataacattaggagaaatggagtggagaattatgttgctaaggatatggtggatgttttgttgcagctcgctgatgatccgaagttggaagttaagctggagagacatggagtcaaagcattcactcaggatatgctggctggtggaaccgagagttcagcagtgacagtggagtgggcaatttcagagctgctaaagaagccggagattttcaaaaaggctacagaagaattggatcgagtaattgggcagaatagatgggtacaagaaaaggacattccaaatcttccttacatagaggcaatagtcaaagagactatgcgactgcaccccgtggcaccaatgttggtgccacgtgagtgtcgagaagatattaaggtagcaggctacgacgttcagaaaggaactagggttctcgtgagtgtatggactattggaagagaccctacattgtgggacgagcctgaggtgttcaagccggagagattccatgaaaggtccatagatgttaaaggacatgattatgagcttttgccatttggagcggggagaagaatgtgcccgggttatagcttggggctcaaggtgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttgattcagcagttctatggttccgtcaagatagactttgttacgtttgaacctgtgctc

SEQ ID NO: 203 - protein, 509 aa, Nicotiana tabacum
MEGTNLTTYAAVFLDTLFLLFLSKLLRQRKLNLPPGPKPWPIIGNLNLIGNLPHRSIHELSLKYGPVMQLQFGSFPVVVGSSVEMAKIFLKSMDINFVGRPKTAAGKYTTYNYSDITWSPYGPYWRQARRMCLTELFSTKRLDSYEYIRAEELHSLLHNLNKISGKPIVLKDYSTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMVDVLLQLADDPKLEVKLERHGVKAFTQDMLAGGTESSAVTVEWAISELLKKPEIFKKATEELDRVIGQNRWVQEKDIPNLPYIEAIVKETMRLHPVAPMLVPRECREDIKVAGYDVQKGTRVLVSVWTIGRDPTLWDEPEVFKPERFHERSIDVKGHDYELLPFGAGRRMCPGYSLGLKVIQASLANLLHGFNWSLPDNMTPEDLNMDEIFGLSTPKKFPLATVIEPRLSPKLYSV

SEQ ID NO: 204 - DNA, 1657 bp, Nicotiana tabacum
cttcttccttcctaactaaaaatggagattcagttttctaacttagttgcattcttgctctttctctccagcatctttcttgtattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcgtcatatcatcacctcaaatggcaaaagaagtactaaaaactcacgacctcgcttttgccactagaccaaagcttgtcgtggccgacatcattcactacgacagcacggacatagcattttcgccatacggtgaatactggagacaaattcgtaaaatttgcatattggaactcttgagtgccaagatggtcaagttttttagctcgattcgccaagatgagctctcgaagatggtttcatctatacgaacgacgcccaatcttccagtcaatcttaccgacaagattttttggtttacgagttcggtaatttgtagatcagctttagggaagatatgtggtgaccaagacaaattgatcatttttatgagggaaataatatcattggcaggtggatttagtattgctgattttttccctacatggaaaatgattcatgatattgatggttcaaaatctaaactggtgaaggcacatcgtaagattgatgaaattttggaaaatgtggtaaatgagcacaaacagaatcgagcagatggtaaaaagggtaatggtgaatttggtggagaagatctgattgatgttttgttaagagttagagaaagtggagaagttcaaattccaatcacagatgacaatatcaaatcaatattaatcgacatgttctctgccggatcggaaacatcatcgacaactataatttgggcattagctgaaatgatgaagaaaccaagtgttttagcaaaggcacaagctgaagtgaggcaagctttgaaggggaagaaaattagttttcaagagattgatattgataagctaaagtatttgaagttagtgatcaaagaaactttaagaatgcaccctccaattcctctgttagtccctagagaatgtatggaagatacaaagattgatggttacaatatacctttcaaaacaagagtcattgttaatgcatgggcaattggacgagatcctcaaagttgggatgatcctgaaagctttacgccagagagatttgagaataattctattgattttcttggaaatcatcatcaatttattccatttggtgcaggaagaaggatttgtcctggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaagtattgctgcttctaggtattttctattggataaatttcaaaattcatccacaatatttagtgtttgctagagttggttagc

SEQ ID NO: 205 - protein, 504 aa, Nicotiana tabacum
MEIQFSNLVAFLLFLSSIFLVFKKWKTRKLNLPPGPWKLPFIGSLHHLAVAGPLPHHGLKNLAKRYGPLMHLQLGQIPTLVISSPQMAKEVLKTHDLAFATRPKLVVADIIHYDSTDIAFSPYGEYWRQIRKICILELLSAKMVKFFSSIRQDELSKMVSSIRTTPNLPVNLTDKIFWFTSSVICRSALGKICGDQDKLIIFMREIISLAGGFSIADFFPTWKMIHDIDGSKSKLVKAHRKIDEILENVVNEHKQNRADGKKGNGEFGGEDLIDVLLRVRESGEVQIPITDDNIKSILIDMFSAGSETSSTTIIWALAEMMKKPSVLAKAQAEVRQALKGKKISFQEIDIDKLKYLKLVIKETLRMHPPIPLLVPRECMEDTKIDGYNIPFKTRVIVNAWAIGRDPQSWDDPESFTPERFENNSIDFLGNHHQFIPFGAGRRICPGMLFGLANVGQPLAQLLYHFDWKLPNGQSHENFDMTESPGISATRKDDLVLIATPYDSY

SEQ ID NO: 206 - DNA, 1610 bp, Nicotiana tabacum
cttcttccttcctaactaaaaatggagattcagttttctaacttagttgcattcttgctctttctctccagcatctttcttgtattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcgtcatatcatcacctcaaatggcaaaagaagtactaaaaactcacgacctcgcttttgccactagaccaaagcttgtcgtggccgacatcattcactacgacagcacggacatagcactttcgccatacggtgaatactggagacaaattcgtaaaatttgcatattggaactcttgagtgccaagatggtcaagttttttagctcgattcgccaagatgagctctcgaagatggtttcatctatacgaacgacgcccaatcttccagtcaatcttaccgacaagattttttggtttacgagttcggtaatttgtagatcagctttagggaagatatgtggtgaccaagacaaattgatcatttttatgagggaaataatatcattggcaggtggatttagtattgctgattttttccctacatggaaaatgattcatgatattgatggttcaaaatctaaactggtgaaggcacatcgtaagattgatgaaattttggaaaatgtggtaaatgagcacaaacagaatcgagcagatggtaaaaagggtaatggtgaatttggtggagaagatctgattgatgttttgttaagagttagagaaagtggagaagttcaaattccaatcacagatgacaatatcaaatcaatattaatcgacatgttctctgccggatcggaaacatcatcgacaactataatttgggcattagctgaaatgatgaagaaaccaagtgttttagcaaaggcacaagctgaagtgagccaagctttgaaggggaagaaaattagttttcaagagattgatattgataagctaaagtatttgaagttagtgatcaaagaaactttaagaatgcaccctccaattcctctgttagtccctagagaatgtatggaagatacaaagattgatggttacaatatacctttcaaaacaagagtcattgttaatgcatgggcaattggacgagatcctcaaagttgggatgatcctgaaagctttacgccagagagatttgagaataattctattgattttcttggaaatcatcatcaatttattccatttggtgcaggaagaaggatttgtcctggaatgctatttggtttagctaatgttggacaacctttagctcagttactttatcacttcgattggaaactccctaatggacaaactcaccaaaatttcgacatgactgagtcacctggaatttctgctacaagaaaggatgatcttattttgattgccactcctgctcattcttgattaagtattgctgcttttctattggagaattttcaaaattcatccacaatatatagtgtttgctagagttggttagc

SEQ ID NO: 207 - protein, 503 aa, Nicotiana tabacum
MEIQFSNLVAFLLFLSSIFLVFKKWKTRKLNLPPGPWKLPFIGSLHHLAVAGPLPHHGLKNLAKRYGPLMHLQLGQIPTLVISSPQMAKEVLKTHDLAFATRPKLVVADIIHYDSTDIALSPYGEYWRQIRKICILELLSAKMVKFFSSIRQDELSKMVSSIRTTPNLPVNLTDKIFWFTSSVICRSALGKICGDQDKLIIFMREIISLAGGFSIADFFPTWKMIHDIDGSKSKLVKAHRKIDEILENVVNEHKQNRADGKKGNGEFGGEDLIDVLLRVRESGEVQIPITDDNIKSILIDMFSAGSETSSTTIIWALAEMMKKPSVLAKAQAEVSQALKGKKISFQEIDIDKLKYLKLVIKETLRMHPPIPLLVPRECMEDTKIDGYNIPFKTRVIVNAWAIGRDPQSWDDPESFTPERFENNSIDFLGNHHQFIPFGAGRRICPGMLFGLANVGQPLAQLLYHFDWKLPNGQTHQNFDMTESPGISATRKDDLILIATPAHS

SEQ ID NO: 208 - DNA, 1664 bp, Nicotiana tabacum
atccttcttccttcctaggtcctaactaaaaatggagattcagttttctaacttagttgcattcttgctctttctctccagcatctttcttctattcaaaaaatggaaaaccagaaaactaaatttgcctcctggtccatggaaattaccttttattggaagtttacaccatttggctgtggcaggtccacttcctcaccatggcctaaaaaatttagccaaacgctatggtcctcttatgcatttacaacttggacaaattcctacactcatcatatcatcacctcaaatggcaaaagaagtactaaaaactcacgacctcgcttttgccactagaccaaagcttgtcgtggccgacatcattcactacgacagcacggacatagcattttctccgtacggtgaatactggagacaaattcgtaaaatttgcatattggaactcttgagtgccaagatggtcaaattttttagctcgattcgccaagatgagctctcgaagatgctctcatctatacgaacgacacccaatcttacagtcaatcttactgacaaaattttttggtttacgagttcggtaacttgtagatcagctttagggaagatatgtggtgaccaagacaaattgatcatttttatgagggaaataatatcattggcaggtggatttagtattgctgattttttccctacatggaaaatgattcatgatattgatggttcgaaatctaaactggtgaaagcacatcgtaagattgatgaaattttgggaaatgttgttgatgagcacaaaaagaacagagcagatggcaagaagggtaatggtgaatttggtggtgaagatttgattgatgtattgttaagagttagagaaagtggagaagttcaaattcctatcacaaatgacaatatcaaatcaatattaatcgacatgttctctgcgggatctgaaacatcatcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctgctacaagaaaggatgatcttgttttgattgccactccttatgattcttattaagcagtagcagaaataaaaagccggggcaaacagaaaaaagtattgctgcttctaggtattttctattggataaatttcaaaattcatccacaatatttagtgtttgctagagttggttagc

SEQ ID NO: 209 - protein, 503 aa, Nicotiana tabacum; identical to SEQ ID NO: 161

SEQ ID NO: 210 - DNA, 1625 bp, Nicotiana tabacum
ttcttattttgattcaaccatggagaaccaatactcctactcattctcttcctacttctacttagctatagtactgtttcttcttccaattttggtcaaatatttcttccatcggagaagaaatttacctccaagtccattttctcttccaataattggtcacctttaccttctcaagaaaactctccatctcactctaacatccttatcagctaaatatggtcctgttttatacctcaaattgggctctatgcctgtgattgttgtgtcctcaccatctgctgttgaagaatgtttaaccaagaatgatatcatattcgcaaataggcccaagaccgtggctggtgacaagtttacctacaattatactgtttatgtttgggcaccctatggccaactttggagaattcttcgccgattaactgtcgttgaactcttctcttcacatagcctacagaaaacttctatccttagagatcaagaagttgcaatatttatccgttcgttatacaaattctcaaaggatagtagcaaaaaagtcgatttgaccaactggtcttttactttggttttcaatcttatgaccaaaattattgctgggagacatattgtgaaggaggaagatgctggcaaggaaaagggcattgaaattattgaaaaacttagagggactttcttagtaactacatcattcttgaatatgtgtgatttcttgccagtattcaggtgggttggttacaaagggctggagaagaagatggcctcaattcacaatagaagaaatgaattcttgaacagcttgcttgatgaatttcgacacaagaaaagtagtgcttcacaatctaacacaactgttggaaacatggagaagaaaaccacactgattgaaaagctcttgtctcttcaagaatcagagcctgaattctacactgatgatatcatcaaaagtattatgctggtagtttttgttgcaggaacagagacctcatcaacaaccatccaatgggtaatgaggcttcttgtagctcaccctgaggcattgtataagctacgagctgacattgacagtaaagttgggaataagcgcttgctgaatgaatcagacctcaacaagcttccgtatttgcattgtgttgttaatgagacaatgagattatacactccgataccacttttattgcctcattattcaactaaagattgtattgtggaaggatatgatgtaccaaaacatacaatgttgtttgtcaacgcttgggccattcacagggatcccaaggtatgggaggagcctgacaagttcaagccagagagatttgaggcaacagaaggggaaacagaaaggttcaattacaagcttgtaccatttggaatggggagaagagcgtgccctggagctgatatggggttgcgagcagtttctttggcattaggtgcacttattcaatgctttgactggcaaattgaggaagcggaaagcttggaggaaagctataattctagaatgactatgcagaacaagcctttgaaggttgtctgcactccacgcgaagatcttggccagcttctatcccaactctaaggcaatttatcaatgccaaacgtaatcttcatctaccactatg

SEQ ID NO: 211 - protein, 520 aa, Nicotiana tabacum
MENQYSYSFSSYFYLAIVLFLLPILVKYFFHRRRNLPPSPFSLPIIGHLYLLKKTLHLTLTSLSAKYGPVLYLKLGSMPVIVVSSPSAVEECLTKNDIIFANRPKTVAGDKFTYNYTVYVWAPYGQLWRILRRLTVVELFSSHSLQKTSILRDQEVAIFIRSLYKFSKDSSKKVDLTNWSFTLVFNLMTKIIAGRHIVKEEDAGKEKGIEIIEKLRGTFLVTTSFLNMCDFLPVFRWVGYKGLEKKMASIHNRRNEFLNSLLDEFRHKKSSASQSNTTVGNMEKKTTLIEKLLSLQESEPEFYTDDIIKSIMLVVFVAGTETSSTTIQWVMRLLVAHPEALYKLRADIDSKVGNKRLLNESDLNKLPYLHCVVNETMRLYTPIPLLLPHYSTKDCIVEGYDVPKHTMLFVNAWAIHRDPKVWEEPDKFKPERFEATEGETERFNYKLVPFGMGRRACPGADMGLRAVSLALGALIQCFDWQIEEAESLEESYNSRMTMQNKPLKVVCTPREDLGQLLSQL

SEQ ID NO: 212 - DNA, 1767 bp, Nicotiana tabacum
aaccaaccttccttttcttacttagtaaaatggatattcagtcttctcctttcaacttaattgctttgctactcttcatttcatttctttttatcctattgaaaaagtggaataccaaaatcccaaagttacctccaggtccatggagacttccccttattggcagcctccatcacttgaaaggtaaactcccacaccatcatcttagagatttagcccgaaaatatggacctctcatgtatttacaacttggagaagttcctgtagttgtaatatcttcgccacgtatagcaaaagctgtactaaaaactcatgatcttgcttttgcaacgaggcctcggttcatgtcctcggacattgtgttttacaaaagcagggacatatcattcgccccatatggcgattactggagacaaatgcgtaaaatattaacacaagaactcttgagtaacaagatgctcaagtcatttagcacaatccgaaaggatgagctctcgaagctcctctcgtcgattcgtttagcaacagcttcttctgcagtgaacataaacgaaaagcttctctggtttacaagttgcatgacttgtagattagcctttggaaaaatatgcaacgatcgtgatgaattgattatgttaataagggagatattagcattatcaggaggatttgatgtgtgtgatttgttcccttcatggaaattacttcacaatatgagcaacatgaaagctagattgacgaatgttcaccataagtataatctaattatggagaatatcatcaatgagcacaaagagaatcatgcagcagggataaagggaaataacgagtttggtggcgaagatatgattgatgctttactgagggttaaggagaataatgagcttcaatttcctatcgaaaatgacaacatgaaagcagtaattctggacttgtttattgctggaactgaaacttcatatactgcaattatatgggcactatcagaattgatgaagcacccaagtgttatggccaaggcacaagctgaagtgagaaaagtcttcaaagaaaatgaaaacttggacgaaaatgatcttgacaagttgccatacttaaaatcagtgatcaaagaaacactaaggatgcatcctccagttcctttattaggacctagagaatgcagagaacaaactgagattgatggatatactgtacctcttaaagctagagtaatggttaatgcatgggcaattggaagagatcctgaaagttgggaagatcctgaaagtttcaaacccgagcgatttgaaaatatttctgttgatcttacgggaaatcactatcagttcatccctttcggttcaggaagaagaatgtgtccaggaatgtcgtttggtttagttaacactgggcatcctttagctcagttgctctatttctttgactggaaattccctcataaggttaatgcagctgattttcacactactgaaacaagtagagtttttgcagcaagcaaagatgacctctacttgattccaacaaatcacatggagcaagagtagctctaaattgaattcttgtcttggaacaataaaagaagaaactccagcttggtctacattatttctttttgctttatattagtatgggtgtgttcagtttcttatttttaagggtaccctgaaagataaagggctatataaaccagtgagactttttattggttgcaaggttttagatcaagccataagacagcatattttattcaaaaaaaaaaaaaaa

SEQ ID NO: 213 - protein, 505 aa, Nicotiana tabacum
MDIQSSPFNLIALLLFISFLFILLKKWNTKIPKLPPGPWRLPLIGSLHHLKGKLPHHHLRDLARKYGPLMYLQLGEVPVVVISSPRIAKAVLKTHDLAFATRPRFMSSDIVFYKSRDISFAPYGDYWRQMRKILTQELLSNKMLKSFSTIRKDELSKLLSSIRLATASSAVNINEKLLWFTSCMTCRLAFGKICNDRDELIMLIREILALSGGFDVCDLFPSWKLLHNMSNMKARLTNVHHKYNLIMENIINEHKENHAAGIKGNNEFGGEDMIDALLRVKENNELQFPIENDNMKAVILDLFIAGTETSYTAIIWALSELMKHPSVMAKAQAEVRKVFKENENLDENDLDKLPYLKSVIKETLRMHPPVPLLGPRECREQTEIDGYTVPLKARVMVNAWAIGRDPESWEDPESFKPERFENISVDLTGNHYQFIPFGSGRRMCPGMSFGLVNTGHPLAQLLYFFDWKFPHKVNAADFHTTETSRVFAASKDDLYLIPTNHMEQE

SEQ ID NO: 214 - DNA, 1736 bp, Nicotiana tabacum
aaccaaccttccttttcttacttagtaaaatggatattcagtcttctcctttcaacttaattgctttgctactcttcatttcatttctttttatcctattgaaaaagtggaataccaaaatcccaaagttacctccaggtccatggagacttccccttattggcagcctccatcacttgaaaggtaaactcccacaccatcatcttagagatttagcccgaaaatatggacctctcatgtatttacaacttggagaagttcctgtagttgtaatatcttcgccacgtatagcaaaagctgtactaaaaactcatgatcttgcttttgcaacgaggcctcggttcatgtcctcggacattgtgttttacaaaagcagggacatatcattcgccccatatggcgattactggagacaaatgcgtaaaatattaacacaagaactcttgagtaacaagatgctcaagtcatttagcacaatccgaaaggatgggctctcgaagctcctctcgtcgattcgtttagcaacagcttcttctgcagtgaacataaacgaaaagcttctctggtttacaagttgcatgacttgtagattagcctttggaaaaatatgcaacgatcgtgatgaattgattatgttaataagggagatattagcattatcaggaggatttgatgtgtgtgatttgttcccttcatggaaattacttcacaatatgagcaacatgaaagctagattgacgaatgttcaccataagtataatctaattatggagaatatcatcaatgagcacaaagagaatcatgcagcagggataaagggaaataacgagtttggtggcgaagatatgattgatgctttactgagggttaaggagaataatgagcttcaatttcctatcgaaaatgacaacatgaaagcagtaattctggacttgtttattgctggaactgaaacttcatatactgcaattatatgggcactatcagaattgatgaagcacccaagtgttatggccaaggcacaagctgaagtgagaaaagtcttcaaagaaaatgaaaacttggacgaaaatgatcttgacaagttgccatacttaaaatcagtgatcaaagaaacactaaggatgcatcctccagttcctttattaggacctagagaatgcagagaacaaactgagattgatggatatactgtacctcttaaagctagagtaatggttaatgcatgggcaattggaagagatcctgaaagttgggaagatcctgaaagtttcaaacccgagcgatttgaaaatatttctgttgatcttacgggaaatcactatcagttcattcctttcggttcaggaagaagaatgtgtccaggaatgtcgtttggtttagttaacactgggcatcctttagctcagttgctctatttctttgactggaaattccctcataaggttaatgcagctgattttcacactactgaaacaagtagagtttttgcagcaagcaaagatgacctctacttgattccaacaaatcacatggagcaagagtagctctaaattgaattcttgtcttggaacgataaaagaagaaactccagcttggtctacattatttctttttgctttatattagtatgggtgtgttcagtttcttgtttttaagggtaccctgaaagataaagggctatataaaccagtgagactttttattgaaaaaaaaaaaaaaaaaaaaaaaaaaaa

SEQ ID NO: 215 - protein, 505 aa, Nicotiana tabacum
MDIQSSPFNLIALLLFISFLFILLKKWNTKIPKLPPGPWRLPLIGSLHHLKGKLPHHHLRDLARKYGPLMYLQLGEVPVVVISSPRIAKAVLKTHDLAFATRPRFMSSDIVFYKSRDISFAPYGDYWRQMRKILTQELLSNKMLKSFSTIRKDELSKLLSSIRLATASSAVNINEKLLWFTSCMTCRLAFGKICNDRDELIMLIREILALSGGFDVCDLFPSWKLLHNMSNMKARLTNVHHKYNLIMENIINEHKENHAAGIKGNNEFGGEDMIDALLRVKENNELQFPIENDNMKAVILDLFIAGTETSYTAIIWALSELMKHPSVMAKAQAEVRKVFKENENLDENDLDKLPYLKSVIKETLRMHPPVPLLGPRECREQTEIDGYTVPLKARVMVNAWAIGRDPESWEDPESFKPERFENISVDLTGNHYQFIPFGSGRRMCPGMSFGLVNTGHPLAQLLYLFDWKFPHKVNAADFHTTETSRVFAASKDDLYLIPTNHMEQE

SEQ ID NO: 216 - DNA, 1823 bp, Nicotiana tabacum
aaccaaccttccttttcttacttagtaaaatggatattcagtcttctcctttcaacttaattgctttgctactcttcatttcatttctttttatcctattgaaaaagtggaataccaaaatcccaaagttacctccaggtccatggagacttccccttattggcagcctccatcacttgaaaggtaaactcccacaccatcatcttagagatttagcccgaaaatatggacctctcatgtatttacaacttggagaagttcctgtagttgtaatatcttcgccacgtatagcaaaagctgtactaaaaactcatgatcttgcttttgcaacgaggcctcggttcatgtcctcggacattgtgttttacaaaagcagggacatatcattcgccccatatggcgattactggagacaaatgcgtaaaatattaacacaagaactcttgagtaacaagatgctcaagtcatttagcacaatccgaaaggatgagctctcgaagctcctctcgtcgattcgtttagcaacagcttcttctgcagtgaacataaacgaaaagcttctctggtttacaagttgcatgacttgtagattagcctttggaaaaatatgcaacgatcgtgatgaattgattatgttaataagggagatattagcattatcaggaggatttgatgtgtgtgatttgttcccttcatggaaattacttcacaatatgagcaacatgaaagctagattgacgaatgttcaccataagtataatctaattatggagaatatcatcaatgagcacaaagagaatcatgcagcagggataaagggaaataacgagtttggtggcgaagatatgattgatgctttactgagggttaaggagaataatgagcttcaatttcctatcgaaaatgacaacatgaaagcagtaattctggacttgtttattgctggaactgaaacttcatatactgcaattatatgggcactatcagaattgatgaagcacccaagtgttatggccaaggcacaagctgaagtgagaaaagtcttcaaagaaaatgaaaacttggacgaaaatgatcttgacaagttgccatacttaaaatcagtgatcaaagaaacactaaggatgcatcctccagttcctttattaggacctagagaatgcagagaacaaactgagattgatggatatactgtacctcttaaagctagagtaatggttaatgcatgggcaattggaagagatcctgaaagttgggaagatcctgaaagtttcaaacccgagcgatttgaaaatatttctgttgatcttacgggaaatcactatcagttcattcctttcggttcaggaagaagaatgtgtccaggaatgtcgtttggtttagttaacactgggcatcctttagctcagttgctctatctctttgactggaaattccctcataaggttaatgcagctgattttcacactactgaaacaagtagagtttttgcagcaagcaaagatgacctctacttgattccaacaaatcacatggagcaagagtagctctaaattgaattcttgtcttggaacaataaaagaagaaactccagcttggtctacattatttccttttgctttatattagtatgggtgtgttcagtctcttgtttttaagggtaccctgaaagataaagggctatataaaccagtgagactttttattggttgcaaggttttagatcaagccataagacagcatattttattccaccattttctatcatgtttaataaagttcctttcgtttattgttagaaaaaaaaaaaaaaaaaaaaaaaa

SEQ ID NO: 217 - protein, 505 aa, Nicotiana tabacum; identical to SEQ ID NO: 215

SEQ ID NO: 218 - DNA, 1673 bp, Nicotiana tabacum
atatgcaactgagatttgaagaataccaactaaccaaaatgcagttcttcagcctggtttccattttcctatttctatctttcctctttttgttaagggtatggaagaactccaatagccaaagcaaaaagttgccaccaggtccatggaaactaccaatactaggaagtatgcttcatatggttggtggactaccacaccatgtccttagagatttagccaaaaaatatggaccacttatgcaccttcaattaggtgaagtttctgcggttgtggttacttctcctgatacggcaaaagaagtattaaaaactcatgacatcgcttttgcgtctaggcctagccttttggccccggagattgtctgttacaataggtctgatctagccttttgcccctatggcgactattggagacaaatgcgtaaaatatgtgtcttggaagtgctcagtgccaagaatgttcggacatttagctctattaggcggaatgaagttcttcgtctcattaattttatccggtcatcttctggtgaacctattaatgttacggaaaggatctttttgttcacaagctccatgacatgtagatcagcgtttgggcaagtgttcaaagagcaagacaaatttatacaactaattaaagaagtgatactcttagcaggagggtttgatgtggctgacatattcccttcactgaagtttcttcatgtgctcagtggaatgaagggtaagattatgaatgcacaccataaggtagatgccattgttgagaatgtcatcaatgagcacaagaaaaatcttgcaattgggaaaactaatggagcgttaggaggtgaagatttaattgatgttcttctaagacttatgaatgatggaggccttcaatttcctatcaccaacgacaacatcaaagctataatttttgacatgtttgctgccgggacagagacttcatcgtcaacaattgtgtgggctatggtagaaatggtgaaaaatccagccgtattcgcgaaagctcaagcagaagtaagagaagcatttagaggaaaagaaactttcgatgaaaatgatgtggaggagctaaactacctaaagttagtaataaaagaaactctaagacttcatccaccggttccacttttgctcccaagagaatgtagggaagagacaaatataaacggctacactattcctgtaaagaccaaagtcatggttaatgtttgggctttgggaagagatccaaaatattggaatgacgcagaaacttttatgccagagagatttgagcagtgctctaaggattttgttggtaataattttgaatatcttccatttggtggcggaaggaggatttgtcctgggatttcgtttggcttagctaatgcttatttgccattggctcaattactatatcacttcgattggaaactccctgctggaatcgaaccaagcgacttggacttgactgagttggttggagtaactgccgctagaaaaagtgacctttacttggttgcgactccttatcaacctcctcaaaagtgatttaatggtttcaagtttttatttcctagcaaaccccactattgtcctatctttcttttggtgttttcggttttatctactctaatacatgcatcttttaccatataggaatgtaccatgttgtcg

SEQ ID NO: 219 - protein, 514 aa, Nicotiana tabacum
MQLRFEEYQLTKMQFFSLVSIFLFLSFLFLLRVWKNSNSQSKKLPPGPWKLPILGSMLHMVGGLPHHVLRDLAKKYGPLMHLQLGEVSAVVVTSPDTAKEVLKTHDIAFASRPSLLAPEIVCYNRSDLAFCPYGDYWRQMRKICVLEVLSAKNVRTFSSIRRNEVLRLINFIRSSSGEPINVTERIFLFTSSMTCRSAFGQVFKEQDKFIQLIKEVILLAGGFDVADIFPSLKFLHVLSGMKGKIMNAHHKVDAIVENVINEHKKNLAIGKTNGALGGEDLIDVLLRLMNDGGLQFPITNDNIKAIIFDMFAAGTETSSSTIVWAMVEMVKNPAVFAKAQAEVREAFRGKETFDENDVEELNYLKLVIKETLRLHPPVPLLLPRECREETNINGYTIPVKTKVMVNVWALGRDPKYWNDAETFMPERFEQCSKDFVGNNFEYLPFGGGRRICPGISFGLANAYLPLAQLLYHFDWKLPAGIEPSDLDLTELVGVTAARKSDLYLVATPYQPPQK

SEQ ID NO: 220 - DNA, 1673 bp, Nicotiana tabacum
atatgcaactgagatttgaagaataccaactaaccaaaatgcagttcttcagcttggtttccattttcctatttctatctttcctctttttgttaaggatatggaagaactccaatagccaaagcaaaaagttgccaccaggtccatggaaactaccaatactaggaagtatgcttcatatggttggtggactaccacaccatgtccttagagatttagccaaaaaatatggaccacttatgcaccttcaattaggtgaagtttctgcggttgtggttacttctcctgatacggcaaaagaagtattaaaaactcatgacatcgcttttgcgtctaggcctagccttttggccccggagattgtctgttacaataggtctgatctagccttttgcccctatggcgactattggagacaaatgcgtaaaatatgtgtcttggaagtgctcagtgccaagaatgttcggacatttagctctattaggcggaatgaagttcttcgtctcattaattttatccggtcatcttctggtgaacctattaatgttacggaaaggatctttttgttcacaagctccatgacatgtagatcagcgtttgggcaagtgttcaaagagcaagacaaatttatacaactaattaaagaagtgatactcttagcaggagggtttgatgtggctgacatattcccttcactgaagtttcttcatgtgctcagtggaatgaagggtaagattatgaatgcacaccataaggtagatgccattgttgagaatgtcatcaatgagcacaagaaaaatcttgcaattgggaaaactaatggagcgttaggaggtgaagatttaattgatgttcttctaagacttatgaatgatggaggccttcaatttcctatcaccaacgacaacatcaaagccataatttttgacatgtttgctgccgggacagagacttcatcgtcaacaattgtgtgggctatggtagaaatggtgaaaaatccagccgtattcgcgaaagctcaagcagaagtaagagaagcatttagaggaaaagaaactttcgatgaaaatgatgtggaggagctaaactacctaaagttagtaataaaagaaactctaagacttcatccaccggttccacttttgctcccaagagaatgtagggaagagacaaatataaacggctacactattcctgtaaagaccaaagtcatggttaatgtttgggctttgggaagagatccaaaatattggaatgacgcagaaacttttatgccagagagatttgagcagtgctctaaggattttgttggtaataattttgaatatcttccatttggtggcggaaggaggatttgtcctgggatttcgtttggcttagctaatgcttatttgccattggctcaattactatatcacttcgattggaaactccctgctggaatcgaaccaagcgacttggacttgactgagttggttggagtaactgccgctagaaaaagtgacctttacttggttgcgactccttatcaacctcctcaaaagtgatttaatggtttcaagtttttatttcctagcaaaccccactattgtcctatctttcttttggtgttttcggttttatctactctaatacatgcatcttttaccatataggaatgtaccatgttgtcg

SEQ ID NO: 221 - protein, 514 aa, Nicotiana tabacum
MQLRFEEYQLTKMQFFSLVSIFLFLSFLFLLRIWKNSNSQSKKLPPGPWKLPILGSMLHMVGGLPHHVLRDLAKKYGPLMHLQLGEVSAVVVTSPDTAKEVLKTHDIAFASRPSLLAPEIVCYNRSDLAFCPYGDYWRQMRKICVLEVLSAKNVRTFSSIRRNEVLRLINFIRSSSGEPINVTERIFLFTSSMTCRSAFGQVFKEQDKFIQLIKEVILLAGGFDVADIFPSLKFLHVLSGMKGKIMNAHHKVDAIVENVINEHKKNLAIGKTNGALGGEDLIDVLLRLMNDGGLQFPITNDNIKAIIFDMFAAGTETSSSTIVWAMVEMVKNPAVFAKAQAEVREAFRGKETFDENDVEELNYLKLVIKETLRLHPPVPLLLPRECREETNINGYTIPVKTKVMVNVWALGRDPKYWNDAETFMPERFEQCSKDFVGNNFEYLPFGGGRRICPGISFGLANAYLPLAQLLYHFDWKLPAGIEPSDLDLTELVGVTAARKSDLYLVATPYQPPQK

SEQ ID NO: 222 - DNA, 1673 bp, Nicotiana tabacum
atatgcaactgagatttgaagaataccaactaaccaaagtgcagttcttcagcttggtttccattttcctatttctatctttcctctttttgttaaggatatggaagaactccaatagccaaagcaaaaagttgccaccaggtccatggaaactaccaatactaggaagtatgcttcatatggttggtggactaccacaccatgtccttagagatttagccaaaaaatatggaccacttatgcaccttcaattaggtgaagtttctgcggttgtggttacttctcctgatacggcaaaagaagtattaaaaactcatgacatcgcttttgcgtctaggcctagccttttggccccggagattgtctgttacaataggtctgatctagccttttgcccctatggcgactattggagacaaatgcgtaaaatatgtgtcttggaagtgctcagtgccaagaatgttcggacatttagctctattaggcggaatgaagttcttcgtctcattaattttatccggtcatcttctggtgaacctattaatgttacggaaaggatctttttgttcacaagctccatgacatgtagatcagcgtttgggcaagtgttcaaagagcaagacaaatttatacaactaattaaagaagtgatactcttagcaggagggtttgatgtggctgacatattcccttcactgaagtttcttcatgtgctcagtggaatgaagggtaagattatgaatgcacaccataaggtagatgccattgttgagaatgtcatcaatgagcacaagaaaaatcttgcaattgggaaaactaatggagcgttaggaggtgaagatttaattgatgttcctctaagacttatgaatgatggaggccttcaatttcctatcaccaacgacaacatcaaagctataatttttgacatgtttgctgccgggacggagacttcatcgtcaacaattgtgtgggctatggtagaaatggtgaaaaatccagccgtattcgcgaaagctcaagcagaagtaagagaagcatttagaggaaaagaaactttcgatgaaaatgatgtggaggagctaaactacctaaagttagtaataaaagaaactctaagacttcatccaccggttccacttttgctcccaagagaatgtagggaagagacaaatataaacggctacactattcctgtaaagaccaaagtcatggttaatgtttgggctttgggaagagatccaaaatattggaatgacgcagaaacttttatgccagagagatttgagcagtgctctaaggattttgttggtaataattttgaatatcttccatttggtggcggaaggaggatttgtcctgggatttcgtttggcttagctaatgcttatttgccattggctcaattactatatcacttcgattggaaactccctgctggaatcgaaccaagcgacttggacttgactgagttggttggagtaactgccgctagaaaaagtgacctttacttggttgcgactccttatcaacctcctcaaaagtgatttaatggtttcaagtttttatttcctagcaaaccccactattgtcctatctttcttttggtgttttcggttttatctactctaatacatgcatcttttaccatataggaatgtaccatgttgtcg

SEQ ID NO: 223 - protein, 514 aa, Nicotiana tabacum
MQLRFEEYQLTKVQFFSLVSIFLFLSFLFLLRIWKNSNSQSKKLPPGPWKLPILGSMLHMVGGLPHHVLRDLAKKYGPLMHLQLGEVSAVVVTSPDTAKEVLKTHDIAFASRPSLLAPEIVCYNRSDLAFCPYGDYWRQMRKICVLEVLSAKNVRTFSSIRRNEVLRLINFIRSSSGEPINVTERIFLFTSSMTCRSAFGQVFKEQDKFIQLIKEVILLAGGFDVADIFPSLKFLHVLSGMKGKIMNAHHKVDAIVENVINEHKKNLAIGKTNGALGGEDLIDVPLRLMNDGGLQFPITNDNIKAIIFDMFAAGTETSSSTIVWAMVEMVKNPAVFAKAQAEVREAFRGKETFDENDVEELNYLKLVIKETLRLHPPVPLLLPRECREETNINGYTIPVKTKVMVNVWALGRDPKYWNDAETFMPERFEQCSKDFVGNNFEYLPFGGGRRICPGISFGLANAYLPLAQLLYHFDWKLPAGIEPSDLDLTELVGVTAARKSDLYLVATPYQPPQK

SEQ ID NO: 224 - DNA, 1580 bp, Nicotiana tabacum
gaaatgggaaatgctcacaacagcaaaattgcagcaatctgtttgataattttcttggtatataaagcatgggaattgttgaagtggatatggattaagccaaagaaactggagagttgcctcagaaaacagggactcaaaggaaattcctacaggctattctatggagatatgaaagaattgtccaaaagtctcaaggaaatcaattcaaagcccatcatcaatctatcaaatgaagtagccccaagaatcattccttattatcttgaaatcatccaaaaatatggtaaaagatgttttgtttggcaaggaccaacccccgcaatattaataacagagccagaattaataaaggagatatttggtaagaactatgtttttcagaagcctaataatcccaacccactgaccaagttattggctcgaggtgttgtaagctacgaggaagaaaaatgggcaaaacacagaaagatcttaaaccctgcctttcatatggagaagttgaagcatatgctaccagcattttacttgagctgtagtgagatgctgaacaaatgggaggagattatcccagtaaaagaatcaaatgagttggacatttggcctcatcttcaaagaatgacaagtgatgtgatttctcgtgctgcctttggtagtagctacgaagaaggaagaagaatatttgaacttcaagaagaacaagctgagtatctaacgaagacattcaattcagtttatatcccaggttccagattttttcccaataaaatgaacaaaagaatgaaagaatgtgaaaaggaagtacgagaaacaattacgtgtctaattgacaacagattaaaggcaaaagaagaaggcaatggcaaggccctcaatgatgacctactgggtatattattagagtcaaattctatagaaattgaagaacatggtaacaagaagtttggaatgagtatacctgaagtaattgaagagtgcaaattattctattttgctggccaagagactacatcagtattgcttgtgtggacactgattttgttagggagaaatccagaatggcaggaacgtgctagagaggaagtttttcaagcctttggaagtgataaaccaacttttgacgaattatatcgcttgaaaattgtgacgatgattttgtacgagtctttaaggttatatccaccaatagcaactcgtactcgaaggactaatgaagaaacaaaattaggggaactagatttaccaaagggtgcactgctctttataccaacaatcttattacatcttgacaaggaaatttggggtgaagatgcagatgagttcaatccggagagatttagcgaaggggtggcaaaggcaacaaaggggaaaatgacatattttccatttggtgcaggaccgcgaaaatgcattgggcaaaacttcgcgattttggaagcaaaaatggctatagctatgattctacaacgcttctccttcgagctctctccatcttatacacactctccatacactgtggtcactttgaaacccaaatatggtgctcccctaataatgcacaggctgtagtcctgtgagaa

SEQ ID NO: 225 - protein, 521 aa, Nicotiana tabacum
MGNAHNSKIAAICLIIFLVYKAWELLKWIWIKPKKLESCLRKQGLKGNSYRLFYGDMKELSKSLKEINSKPIINLSNEVAPRIIPYYLEIIQKYGKRCFVWQGPTPAILITEPELIKEIFGKNYVFQKPNNPNPLTKLLARGVVSYEEEKWAKHRKILNPAFHMEKLKHMLPAFYLSCSEMLNKWEEIIPVKESNELDIWPHLQRMTSDVISRAAFGSSYEEGRRIFELQEEQAEYLTKTFNSVYIPGSRFFPNKMNKRMKECEKEVRETITCLIDNRLKAKEEGNGKALNDDLLGILLESNSIEIEEHGNKKFGMSIPEVIEECKLFYFAGQETTSVLLVWTLILLGRNPEWQERAREEVFQAFGSDKPTFDELYRLKIVTMILYESLRLYPPIATRTRRTNEETKLGELDLPKGALLFIPTILLHLDKEIWGEDADEFNPERFSEGVAKATKGKMTYFPFGAGPRKCIGQNFAILEAKMAIAMILQRFSFELSPSYTHSPYTVVTLKPKYGAPLIMHRL

SEQ ID NO: 226 - DNA, 1587 bp, Nicotiana tabacum
atgctttctcccatagaagcctttgtaggactagtaaccttcacatttctcttatacttcctatggacaaaaaaatctcaaaaacttccaaaacccttaccaccgaaaatccccggaggatggccggtaatcggccatctttttcacttcaataacgacggcgacgaccgtccattagctcgaaagctcggagacttagctgataaatacggccccgttttcacttttcggctaggtcttccccttgtgctagttgtaagcagttacgaagctataaaagattgcttctctacaaatgatgccattttctccaatcgtccagctcttctttacggcgaataccttggctacaataatacaatgctttttctagcaaattacggaccttactggcgaaaaaatcgtaaattagtcattcaggaagttctctctgctagtcgtctcgaaaaattcaaacaagtgagattcaccagaattcaaacgagcattaagaatttatacactcgaattaatggaaattcgagtacgataaatctaactgattggttagaagaattgaattttggtctgatcgtgaaaatgatcgctgggaaaaattatgaatccggtaaaggagatgaacaagtggaaagatttaagaatgcgtttaaggattttatggttttatcaatggaatttgtattatgggatgcatttccaattccattatttaaatgggtggattttcaaggtcatattaaggcaatgaaaaggacatttaaggatatagattctgtttttcagaactggttagaggaacatattaataaaagagaaaaaatagaggttggtgcagaagggaatgaacaagatttcattgatgtggtgctttcaaaattgagtaaagaatatcttgatgaaggttactctcgtgatactgtcattaaagcaacagtttttagtttggtcttggatgcagcagacacagttgctcttcacataaattggggaatgacattattgataaacaatcaaaatgccttgatgaaagcacaagaagagatagacacaaaagttggtaaggatagatgggtagaagagagtgatattaaggatttagtatacctccaagctattgttaaaaaggtgttacgattatatccaccaggacctttgttagtaccacatgaaaatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttactaaaacctaagatgtttcatcttggttgatcattgt

SEQ ID NO: 227 - protein, 517 aa, Nicotiana tabacum
MLSPIEAFVGLVTFTFLLYFLWTKKSQKLPKPLPPKIPGGWPVIGHLFHFNNDGDDRPLARKLGDLADKYGPVFTFRLGLPLVLVVSSYEAIKDCFSTNDAIFSNRPALLYGEYLGYNNTMLFLANYGPYWRKNRKLVIQEVLSASRLEKFKQVRFTRIQTSIKNLYTRINGNSSTINLTDWLEELNFGLIVKMIAGKNYESGKGDEQVERFKNAFKDFMVLSMEFVLWDAFPIPLFKWVDFQGHIKAMKRTFKDIDSVFQNWLEEHINKREKIEVGAEGNEQDFIDVVLSKLSKEYLDEGYSRDTVIKATVFSLVLDAADTVALHINWGMTLLINNQNALMKAQEEIDTKVGKDRWVEESDIKDLVYLQAIVKKVLRLYPPGPLLVPHENVKDCVVSGYHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 228 - DNA, 1634 bp, Nicotiana tabacum
gggagaaggccttcaatatggagataccatattacagcttaaaaattgcaatttcttcatttgcaattatctttgtactaagatgggcatggaaaatcttgaattatgtgtggttaaaaccaaaagaattggagaaatacctcagacagcagggtttcaaaggaaactcttacaaattcttgtttggggatatgaaagagacgaagaaaatgggtgaagaagctatgtctaagccaatcaatttctctcatgacatgatttggcctagagttatgccattcatccacaaaaccatcaccaattatggtaagaattgtattgtgtggtttgggccaagaccagcagtcctgatcacagacccggaacttgtaaaggaggtgctaacgaagaatttcgtctatcagaagccgcttggcaatccactcacaaagttggcagcaactggaattgcaggctatgaaacagataaatgggctacacatagaaggcttctcaatcctgcttttcaccttgacaagttgaagcatatgctacctgcattccaatttactgctagtgagatgttgagcaaattggagaaagttgtttcaccaaacggaacagagatagatgtgtggccatatttacaaactttgacaagtgatgccatttcaagaactgcgtttggaagtagttatgaagaaggaagaaagatttttgaccttcaaaaagaacaactttcactaattctagaagtttcacgcacaatatatattccaggatggaggtttttgccaacgaaaaggaacaaaaggatgaagcaaatatttaatgaagtacgagcactggtatttggaattattaagaaaaggatgagtatgattgaaaatggagaagcacctgatgatttattgggaatattattggcatccaatttaaaagaaatccaacaacatggaaacaacaagaaatttggtatgagtattgatgaggtgattgaagagtgtaaactcttctattttgctgggcaagagactacttcatctttacttgtatggactatgattttgttgtgcaaatatcctaattggcaagataaagctagagaagaggttttgcaagtgtttgggagtagggaagttgactatgacaagttgaatcagctaaaaatagtaactatgatcttaaacgaggtcttaaggttgtatccagcaggatatgtgattaatcgaatggtaaacaaagaaacaaagttagggaatttgtgtttaccagccggcgtacagctcgtgttaccaacaatgttgttgcaacatgatactgaaatatggggagatgatgcaatggagttcaatccagagagatttagtgatggaatatccaaagcaacaaaaggaaaacttgtgttttttccatttagttggggtccaagaatatgtattgggcaaaattttgctatgttagaggctaaaatggcaatggctatgattctgaaaacctatgcatttgaactctctccatcttatgctcatgctcctcatccactactacttcaacctcaatatggtgctcaattaattttgtacaagttgtagatatggtcaatctggaacttgttatggaacttttatcatcgtaatcaaccatattgaggg

SEQ ID NO: 229 - protein, 518 aa, Nicotiana tabacum
MEIPYYSLKIAISSFAIIFVLRWAWKILNYVWLKPKELEKYLRQQGFKGNSYKFLFGDMKETKKMGEEAMSKPINFSHDMIWPRVMPFIHKTITNYGKNCIVWFGPRPAVLITDPELVKEVLTKNFVYQKPLGNPLTKLAATGIAGYETDKWATHRRLLNPAFHLDKLKHMLPAFQFTASEMLSKLEKVVSPNGTEIDVWPYLQTLTSDAISRTAFGSSYEEGRKIFDLQKEQLSLILEVSRTIYIPGWRFLPTKRNKRMKQIFNEVRALVFGIIKKRMSMIENGEAPDDLLGILLASNLKEIQQHGNNKKFGMSIDEVIEECKLFYFAGQETTSSLLVWTMILLCKYPNWQDKAREEVLQVFGSREVDYDKLNQLKIVTMILNEVLRLYPAGYVINRMVNKETKLGNLCLPAGVQLVLPTMLLQHDTEIWGDDAMEFNPERFSDGISKATKGKLVFFPFSWGPRICIGQNFAMLEAKMAMAMILKTYAFELSPSYAHAPHPLLLQPQYGAQLILYKL

SEQ ID NO: 230 - DNA, 1593 bp, Nicotiana tabacum
atggtttttcccatagaagcctttgtaggactagtaaccttcacatttctcttatacttcctatggacaaaaaaatctcaaaaacttccaaaacccttaccaccgaaaatccccggaggatggccggtaatcggccacctttttcacttcaataacgacggcgacgaccgtccattagctcgaaaactcggagacttagctgataaatacggccccgttttcacttttcggctaggtcttccccttgtgctagttgtaagcagttacgaagctacaaaagattgcttctctacaaatgacgccattttctccaatcgtccagcttttctttacggcgaataccttggctacaataatacaatgctttttctagcaaattacggaccttactggcgaaaaaatcgtaaattagtcattcaggaagttctctctgctagtcgtctcgaaaaattcaaacaagtgagattcaccagaattcaaacgagcattaagaatttatacactcgaattaatggaaattcgagtacgataaatctaactgattggttagaagaattgaattttggtctgatcgtgaaaatgatcgctgggaaaaattatgaatccggtaaaggagatgaacaagtggaaagatttaagaatgcgtttaaggattttatggttttatcaatggaatttgtattatgggatgcatttccaattccattatttaaatgggtggattttcaaggtcatattaagacaatgaaaaggacatttaaggatatagattctgtttttcagaactggttagaggaacatattaataaaagagaaaaaatggaggttggtgcagaagggaatgaacaagatttcattgatgtggtgctttcaaaattgagtaaagaatatcttgatgaaggttactctcgtgatactgtcattaaagcaacagtttttagtttggtcttggatgcagcagacacagttgctcttcacataaattggggaatgacattattgataaacaatcaaaatgccttgatgaaagcacaagaagagatagacacaaaagttggtaaggatagatgggtagaagagagtgatattaaggatttagtatacctccaagctattgttaaaaaggtgttacgattatatccaccaggacctttgttagtaccacatgaaaatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatctggttctggaagacgatcttgtccggggatgacttatgcattgcaagtggaacacctaacaatggcacatttaatccagggtttcaattacaaaactccaaatgacgaggtcttggatatgaaggaaggtgcaggcataacaatacgtaaggtaaatccagtggaattgataataacgcctcgcttggcacctgagctttactaaaacctaagatctttcatcttggttgatcattgtttaata

SEQ ID NO: 231 - protein, 517 aa, Nicotiana tabacum
MVFPIEAFVGLVTFTFLLYFLWTKKSQKLPKPLPPKIPGGWPVIGHLFHFNNDGDDRPLARKLGDLADKYGPVFTFRLGLPLVLVVSSYEATKDCFSTNDAIFSNRPAFLYGEYLGYNNTMLFLANYGPYWRKNRKLVIQEVLSASRLEKFKQVRFTRIQTSIKNLYTRINGNSSTINLTDWLEELNFGLIVKMIAGKNYESGKGDEQVERFKNAFKDFMVLSMEFVLWDAFPIPLFKWVDFQGHIKTMKRTFKDIDSVFQNWLEEHINKREKMEVGAEGNEQDFIDVVLSKLSKEYLDEGYSRDTVIKATVFSLVLDAADTVALHINWGMTLLINNQNALMKAQEEIDTKVGKDRWVEESDIKDLVYLQAIVKKVLRLYPPGPLLVPHENVKDCVVSGYHIPKGTRLFANVMKLQRDPKLLSNPDKFDPERFIAGDIDFRGHHYEFIPSGSGRRSCPGMTYALQVEHLTMAHLIQGFNYKTPNDEVLDMKEGAGITIRKVNPVELIITPRLAPELY

SEQ ID NO: 232 - DNA, 1580 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctccacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcatgaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattgaagcaacggtgtttagtttggtcttggatgcagcagacacagttgctcttcacataaattggggaatggcattattgataaacaatcaaaaggccttgacgaaagcacaagaagagatagacacaaaagtttgtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggtcctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatgtttcatcttggttga

SEQ ID NO: 233 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASMKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIEATVFSLVLDAADTVALHINWGMALLINNQKALTKAQEEIDTKVCKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGPGRRSCPGMTYALQVEHLTMAHLIQGFNYRTPNDEPLDMKEGAGITIRKVNPVELIIAPRLAPELY

SEQ ID NO: 234 - DNA, 1639 bp, Nicotiana tabacum
tttcatatacctttagtactcttgaaattttcaaataatggtttatcttctttctcccatagaagccattgtaggatttgtaaccttttcatttctattctactttctatggaccaaaaaacaatcaaaaatcttaaacccactacctccaaaaatcccaggtggatggccagtaatcggccatctcttttatttcaagaacaatggcgatgaagatcgccatttttctcaaaaactcggtgacttagctgacaaatatggtcccgtcttcactttccggttagggtttcgccgtttcttggcggtgagtagttatgaagctatgaaagaatgcttcactaccaatgatatccatttcgccgatcggccatctttactctacggagaatacctttgctataataacgccatgcttgctgttgccaaatatggcccttactggaaaaaaaatcgaaagttagtcaatcaagaagttctctccgttagtcggctcgaaaaattcaaacatgttagattttctataattcagaaaaatattaaacaattgtataattgtgattcaccaatggtgaagataaaccttagtgattggatagataaattgacattcgacatcattttgaaaatggttgttgggaagaactataataatggacatggagaaatactcaaagttgcttttcagaaattcatggttcaagctatggagatggagctctatgatgtttttcacattccatttttcaagtggttggatcttacagggaatattaaggctatgaaacaaactttcaaagacattgataatattatccaaggttggttagatgagcacattaagaagagagaaacaaaggatgttggaggtgaaaacgaacaagattttatagatgtggtgctttccaagatgagcgacgaacatcttggcgagggttactctcatgacacaaccatcaaagcaactgtattcactttggtcttggatgcaacagacacacttgcacttcatataaagtgggtaatggcgttaatgataaacaataagcatgtcatgaagaaagcacaagaagagatggacacaattgttggtagagatagatgggtagaagagagtgatatcaagaatttggtgtatctccaagcaattgtcaaagaagtattacgattacatccacccgcacctttgtcagtgcaacacctatctgtagaagattgtgttgtcaatgggtaccatattcctaaggggactgcactacttaccaatattatgaaactacagcgagatcctcaaacatggccaaatcctgataaattcgatccagagagattcctgacgactcatgctactattgactaccgcgggcagcactatgagtcgatcccctttggtacggggagacgagcttgtcccgcgatgaattattcattgcaagtggaacacctttcaattgctcatatgatccaaggtttcagttttgcaactacgaccaatgagcctttggatatgaaacaaggtgtgggtttaactttaccaaagaagactgatgttgaagtgctaattacacctcgccttcctcctacgctttatcaatattaagatgttttgttgtcgggattcgttctgatcaatccctcaatg

SEQ ID NO: 235 - protein, 519 aa, Nicotiana tabacum
MVYLLSPIEAIVGFVTFSFLFYFLWTKKQSKILNPLPPKIPGGWPVIGHLFYFKNNGDEDRHFSQKLGDLADKYGPVFTFRLGFRRFLAVSSYEAMKECFTTNDIHFADRPSLLYGEYLCYNNAMLAVAKYGPYWKKNRKLVNQEVLSVSRLEKFKHVRFSIIQKNIKQLYNCDSPMVKINLSDWIDKLTFDIILKMVVGKNYNNGHGEILKVAFQKFMVQAMEMELYDVFHIPFFKWLDLTGNIKAMKQTFKDIDNIIQGWLDEHIKKRETKDVGGENEQDFIDVVLSKMSDEHLGEGYSHDTTIKATVFTLVLDATDTLALHIKWVMALMINNKHVMKKAQEEMDTIVGRDRWVEESDIKNLVYLQAIVKEVLRLHPPAPLSVQHLSVEDCVVNGYHIPKGTALLTNIMKLQRDPQTWPNPDKFDPERFLTTHATIDYRGQHYESIPFGTGRRACPAMNYSLQVEHLSIAHMIQGFSFATTTNEPLDMKQGVGLTLPKKTDVEVLITPRLPPTLYQY

SEQ ID NO: 236 - DNA, 1610 bp, Nicotiana tabacum
ctttttctccccaaaaaagagctcatttcccttgtccccaaaaatggatcttctcttactagagaagaccttaattggtctcttctttgccattttaatcgctataattgtctctagacttcgttcaaagcgttttaagcttcccccaggaccaatcccagtaccagtttttggtaattggcttcaagttggtgatgatttaaaccacagaaatcttactgattttgccaaaaaatttggtgatcttttcttgttaagaatgggccagcgtaatttagttgttgtgtcatctcctgaattagctaaagaagttttacacacacaaggtgttgaatttggttcaagaacaagaaatgttgtatttgatatttttactggaaaaggtcaagatatggtttttactgtatatggtgaacactggagaaaaatgaggagaattatgactgtaccattttttactaataaagttgtgcagcaatatagaggggggtgggagtttgaagtggcaagtgtaattgaggatgtgaagaaaaatcctgaatctgctactaatgggattgtattaaggaggagattacaattgatgatgtataataatatgtttaggattatgtttgataggagatttgagagtgaagatgatcctttgtttgttaagcttaaggctttgaatggtgaaaggagtagattggctcagagttttgagtataattatggtgattttattcccattttgaggccttttttgagaggttatttgaagatctgtaaagaagttaaggagaagaggctgcagcttttcaaagattactttgttgatgaaagaaagaagctttcaaataccaagagcttggacagcaatgctctgaaatgtgcgattgatcacattcttgaggctcaacagaagggggagatcaatgaggacaacgttctttacattgttgaaaacatcaatgttgctgctatagaaaccacattatggtcaattgagtggggtatcgccgagttagtcaaccaccctcacatccaaaagaaactccgcgacgagattgacacagttcttggcccaggagtgcaagtgactgaaccagacacccacaagcttccataccttcaggctgtgatcaaggagacgcttcgtctccgtatggcaattcctctattagtcccacacatgaaccttcacgatgcaaagcttggcgggtttgatattccagcagagagcaaaatcttggttaacgcttggtggctagctaacaacccggctcattggaagaaacccgaagagttcagacccgagaggttcttcgaagaggagaagcacgttgaggccaatggcaatgacttcagatatcttccgtttggcgttggtaggaggagttgccctggaattatacttgcattgccaattcttggcattactttgggacgtttggttcagaactttgagctgttgcctcctccaggccagtcgaagctcgacaccacagagaaaggtggacagttcagtctccatattttgaagcattccaccattgtgttgaaaccaaggtcttgctgaactttctgatcctaatcaattaaggggttgaagaaattttataattatg

SEQ ID NO: 237 - protein, 505 aa, Nicotiana tabacum
MDLLLLEKTLIGLFFAILIAIIVSRLRSKRFKLPPGPIPVPVFGNWLQVGDDLNHRNLTDFAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPFLRGYLKICKEVKEKRLQLFKDYFVDERKKLSNTKSLDSNALKCAIDHILEAQQKGEINEDNVLYIVENINVAAIETTLWSIEWGIAELVNHPHIQKKLRDEIDTVLGPGVQVTEPDTHKLPYLQAVIKETLRLRMAIPLLVPHMNLHDAKLGGFDIPAESKILVNAWWLANNPAHWKKPEEFRPERFFEEEKHVEANGNDFRYLPFGVGRRSCPGIILALPILGITLGRLVQNFELLPPPGQSKLDTTEKGGQFSLHILKHSTIVLKPRSC

SEQ ID NO: 238 - DNA, 1595 bp, Nicotiana tabacum
aacaataaaaatggagacattatttaacatcaaagttgcagtttcattagtaattgtgataatttttctgagatgggtatggaaattcttgaattgggtgtggattcaaccaaagaaaatggaaaaaagactaaaaatggaaggtttcaaaggaagctcatataagctattatttggagatatgaaagaaataaatacaatggttgaagaagccaaaaccaagcctatgaattttaccaatgattatgtggctagagtcttgcctcacttcacaaagttgatgctccaatatggcaagaatagctttatgtggttagggccaaaaccaacaatgtttatcacagaccctgaactaataagggagatcttgtcaaaaagttacatataccaggagattcaaggcaatccaatcactaagttgctagcacaaggactagtaagttatgaagcagagaaatgggctaagcatagaaaaattatcaatcctgcatttcaccttgacaagttgaagcatatgctaccatcattctacttgagttgttgtgacatgctcagaaaatgggaaagtatagcttcatcagagggatcagaaatagacgtgtggccttttctggaaacgttgacaagcgatgctatttcaagaacagcttttggtagtaactatgaagacgggagacagatatttgagcttcaaaaagaacaagctgagttgattttacaagcagcgcgatggctttacatccccggatggaggtttgtgccaacaaagaggaacaagaggatgaagcaaatcgctaaagaagtacgatcattagtgttgggaataatcaataagagaataagggaaatgaaagcaggggaagctgcaaaagatgacttactgggaatactattggaatctaatttcaaagaaatccaaatgcacggaaacaagaactttggcatgactatcgacgaagtgattgaagagtgcaagttattttactttgctgggcaagaaactacttcagttttgcttgtttggactttgattttactgagtaagcatgtcgattggcaagaaagagctagagaagaagttcatcaagtctttggaagtaacaaacctgattatgacgcattgaatcagttgaaagttgtaacgatgatattcaacgaggttttaaggttgtacccaccgggaattaccataagtcgaactgtacacgaggataccaaattagggaacttgtcattgccagcagggatacagcttgtgttacctgcaatttggttgcatcatgacaatgaaatatggggagatgatgcaaaggagttcaaaccagagaggtttagtgaaggagttaataaagcaacaaagggtaaatttgcatattttccatttagttggggaccaagaatatgtgttggactgaattttgcaatgttagaggcaaaaatggcacttgcattgattctacaacactatgcttttgagctctctccatcttatgcacatgctcctcatacaattatcactctgcaacctcaacatggtgctcctttgattttgcgcaagctgtagcgcggatatattgattggttatctactgtag

SEQ ID NO: 239 - protein, 517 aa, Nicotiana tabacum
METLFNIKVAVSLVIVIIFLRWVWKFLNWVWIQPKKMEKRLKMEGFKGSSYKLLFGDMKEINTMVEEAKTKPMNFTNDYVARVLPHFTKLMLQYGKNSFMWLGPKPTMFITDPELIREILSKSYIYQEIQGNPITKLLAQGLVSYEAEKWAKHRKIINPAFHLDKLKHMLPSFYLSCCDMLRKWESIASSEGSEIDVWPFLETLTSDAISRTAFGSNYEDGRQIFELQKEQAELILQAARWLYIPGWRFVPTKRNKRMKQIAKEVRSLVLGIINKRIREMKAGEAAKDDLLGILLESNFKEIQMHGNKNFGMTIDEVIEECKLFYFAGQETTSVLLVWTLILLSKHVDWQERAREEVHQVFGSNKPDYDALNQLKVVTMIFNEVLRLYPPGITISRTVHEDTKLGNLSLPAGIQLVLPAIWLHHDNEIWGDDAKEFKPERFSEGVNKATKGKFAYFPFSWGPRICVGLNFAMLEAKMALALILQHYAFELSPSYAHAPHTIITLQPQHGAPLILRKL

SEQ ID NO: 240 - DNA, 1673 bp, Nicotiana tabacum; identical to SEQ ID NO: 220

SEQ ID NO: 241 - protein, 514 aa, Nicotiana tabacum; identical to SEQ ID NO: 221

SEQ ID NO: 242 - DNA, 1601 bp, Nicotiana tabacum
gaattatttcacgtgttgtattccttgtctatgataggaagctcgttacctcagcgtacaaaccccaaataaaaaatgaatttccttgtggtgttagcttctctctttctctttgtgttcctaatgaggataagcaaagcaaaaaagctccctccaggtccaaggaaactgcctataataggaaaccttcatcaaattggaaaattacctcatcgttcacttcaaaaactttctaatgaatatggggatttcattttcttgcaattaggttctgtaccgactgtggttgtctcctcagctgacattgcccgagagatctttagaactcacgaccttgttttctcaggccgtcctgctttatatgctgccagaaaactttcctacaattgctacaacgtttcatttgcaccctatggtaattactggagagaggctcggaaaattctagtgttggagttgctaagtacaaagagagtacaaagtttcgaggcaattcgagacgaggaagtaagtagcttggttcaaattatctgtagttccttgagctcacctgttaacataagcacattagcactatccttggcaaataacgttgtttgtcgagtggcttttgggaaagggagtgctgaaggaggaaatgattatgaggataggaagtttaatgaaattctatatgagacacaagaattattgggtgagtttaacgttgctgattattttcctcggatggcatggattaacaaaataaatgggtttgatgaacgattggaaaataattttagggaattggataagttttatgacaaagtaatagaagatcatcttaattcatgtagctggatgaaacaaagggatgatgaagacgttattgatgtattgcttcgaattcaaaaggatccaagccaagaaattcctctcaaagatgatcacattaagggccttcttgcggatatattcatagctggaactgatacatcatcaacaaccatagaatgggcaatgtcagaactcataaaaaatccaagagtcttgagaaaagctcaagaggaagttagagaagtttctaagggaaaacaaaaggtccaagaaagtgatctttgcaaactagattacttgaaattggtcatcaaagaaacctttagactacacccaccagtcccattactagtccctcgagtaacaacagccagctgcaaaataatggaatacgaaattccagtaaatacaagagtcttcatcaacgcgacagcaaatgggacaaatccaaaatactgggaaaatccattgacattcttgccagagagattcttggataaggagattgattacagaggcaaaaattttgagttgttgccatttggggcagggagaagagggtgtccaggaattaatttttcaataccacttgttgagcttgcacttgctaatctattgtttcattataattggtcacttcctgaagggatgctagctaaggatgttgatatggaagaagctttggggattaccatgcacaagaaatctcccctttgcttagtagcttctcattatacttgttgagattttaaaagattttagcatagctatatatagcttgaagt

SEQ ID NO: 243 - protein, 494 aa, Nicotiana tabacum
MNFLVVLASLFLFVFLMRISKAKKLPPGPRKLPIIGNLHQIGKLPHRSLQKLSNEYGDFIFLQLGSVPTVVVSSADIAREIFRTHDLVFSGRPALYAARKLSYNCYNVSFAPYGNYWREARKILVLELLSTKRVQSFEAIRDEEVSSLVQIICSSLSSPVNISTLALSLANNVVCRVAFGKGSAEGGNDYEDRKFNEILYETQELLGEFNVADYFPRMAWINKINGFDERLENNFRELDKFYDKVIEDHLNSCSWMKQRDDEDVIDVLLRIQKDPSQEIPLKDDHIKGLLADIFIAGTDTSSTTIEWAMSELIKNPRVLRKAQEEVREVSKGKQKVQESDLCKLDYLKLVIKETFRLHPPVPLLVPRVTTASCKIMEYEIPVNTRVFINATANGTNPKYWENPLTFLPERFLDKEIDYRGKNFELLPFGAGRRGCPGINFSIPLVELALANLLFHYNWSLPEGMLAKDVDMEEALGITMHKKSPLCLVASHYTC

SEQ ID NO: 244 - DNA, 1570 bp, Nicotiana tabacum
caaagactaaaagatgtcggtctttgcggttatttcattctttctacttctgttttttcttttcaaatcatatttgccctcatcgaaaacaaagaaaaattctccaccatctccttcaaagcttccgttaatcggtcacttccacaaactaggcttacaacctcaccgttctctacaaaaactatcaaatgaacatggtcccatgatgatgcttcaattcggtagcgtacctgtgcttatcgcttcatcagctgaagctgcttccgaaatcatgaaaacccaagatttgtcttttgcaaacaaacccatttcaaccattcctagcaagcttttcttcggcccaaaggacgttgccttcaccccatatggggattactggaggaatgccagaagcatttgcatgcttcagcttttgaacaacaaaagagtccagtcttttcgaaagataagggaagaagagacttctcttcttctccagaggattagggaatcgccaaattcagaagtcgatttaacggagctgttcgtttccatgactaacgacatagtttgcagggtggccttaggaaggaagtattgtgatggggaagaagggaggaaattcaagtctttgctgttagagtttgtggaattgttgggagtttttaacattggagattacatgccgtggcttgcatggatgaatcgtttcaatggtttgaatgccaaagtggataaagtggcgaaagagtttgatgcatttttggaggatgtgattgaggaacacggaggaaataagaaatcagacactgaagctgaaggggcagacttcgtggatatattattgcaggttcacaaagaaaacaaggctggttttcaagtcgaaatggatgcaatcaaagctattatcatggatatgtttgctgcgggaacagatacaacttccacgcttctagagtggacaatgaacgagctcttaagaaatccaaaaacattgaataagttgagagatgaggtgagacaagtgactcaagggaagacagaggtaacagaggatgacttagagaaaatgccgtatttaagagcagcagttaaggagagttccaggctacactctccagtgccacttctacctcgagaagcaattaaggatgcaaaggttttgggctacgatatagctgcagggactcaagtcctcgtttgtccatgggcaatctcaagagatccaaacctttgggaaaatccagaggagtttcaacctgaaagattcttggatacttccatagattacaaaggcttacatttcgagttaattccattcggtgcaggtcggaggggttgccctggcatcacatttgctaagtttgtgaatgagctagcattggcaagattaatgttccattttgatttctcgctaccaaaaggagttaagcatgaggatttggacgtggaggaagctgctggaattactgttagaaggaagttcccccttttagccgtcgccactccatgctcgtgatttttattttagagctcattctatgccttaaaaactactactagataactgcgtagtaaataatgcttggta

SEQ ID NO: 245 - protein, 494 aa, Nicotiana tabacum
MSVFAVISFFLLLFFLFKSYLPSSKTKKNSPPSPSKLPLIGHFHKLGLQPHRSLQKLSNEHGPMMMLQFGSVPVLIASSAEAASEIMKTQDLSFANKPISTIPSKLFFGPKDVAFTPYGDYWRNARSICMLQLLNNKRVQSFRKIREEETSLLLQRIRESPNSEVDLTELFVSMTNDIVCRVALGRKYCDGEEGRKFKSLLLEFVELLGVFNIGDYMPWLAWMNRFNGLNAKVDKVAKEFDAFLEDVIEEHGGNKKSDTEAEGADFVDILLQVHKENKAGFQVEMDAIKAIIMDMFAAGTDTTSTLLEWTMNELLRNPKTLNKLRDEVRQVTQGKTEVTEDDLEKMPYLRAAVKESSRLHSPVPLLPREAIKDAKVLGYDIAAGTQVLVCPWAISRDPNLWENPEEFQPERFLDTSIDYKGLHFELIPFGAGRRGCPGITFAKFVNELALARLMFHFDFSLPKGVKHEDLDVEEAAGITVRRKFPLLAVATPCS

SEQ ID NO: 246 - DNA, 1585 bp, Nicotiana tabacum
attatccatcacctaaaatggagaattcttgggtttttctagccttggcagggctatctgcattagcttttctctgtaaaataatcacctgtcgaagaccggttaaccggaaaataccaccaggtccaaaaccatggcccatcattggcaatttgaacctacttggtcctataccacatcaatcttttgacttgctttccaaaaaatatggagagttgatgctgctgaaatttggctccaggccagttcttgttgcttcatctgctgaaatggcaaaacagtttttaaaagtacatgatgctaatttcgcctcccgtcctatgctagctggtggaaagtatacaagctataactattgtgacatgacatgggcaccctatggtccctattggcgccaagcacgacgaatttaccttaaccagatatttactccgaaaaggctagactcgttcgagtacattcgtgttgaagaaaggcaggccttgatttcccagctgaattcccttgctggaaagccattttttctcaaagaccatttgtcgcgatttagcctctgcagcatgacaaggatggttttgagcaacaagtactttggtgaatcaacagttagagtagaagatttgcagtacctggtagatcaatggttcttacttaatggtgctttcaacattggagattggattccatggctcagcttcttggacctacaaggctatgtgaaacaaatgaaggctttgaaaagaacttttgataagttccacaacattgtgctagatgatcgcagggctaagaagaatgcagagaagaactttgtcccaaaagacatggttgatgtcttgttgaagatggctgaagatcctaatctggaagtcaaactcactaatgactgtgtcaaagggttaatgcaggatttactaactggaggaacagatagcttaacagcagcagtgcaatgggcatttcaagaacttcttagacggccaagggttattgagaaggcaaccgaagagcttgaccggattgtcgggaaagagagatgggtagaagagaaagattgctcgcagctatcttacgttgaagcaatcctcaaggaaacactaaggttacatcctctaggaactatgctagcaccgcattgtgctatagaagattgtaacgtggctggttatgacatacagaaaggaacgaccgttctggtgaatgtttggaccattggaagggacccaaaatactgggatagagcacaagagtttctccccgagagattcttagagaacgacattgatatggacggacataactttgctttcttgccatttggctcggggcgaaggaggtgccctggctatagccttggacttaaggttatccgagtaacattagccaacatgttgcatggattcaactggaaattacctgaaggtatgaagccagaagatataagtgtggaagaacattatgggctcactacacatcctaagtttcctgttcctgtgatcttggaatctagactttcttcagatctctattcccccatcacttaatcctaagtgcttcctattatagcatcatatcaatatccctc

SEQ ID NO: 247 - protein, 508 aa, Nicotiana tabacum
MENSWVFLALAGLSALAFLCKIITCRRPVNRKIPPGPKPWPIIGNLNLLGPIPHQSFDLLSKKYGELMLLKFGSRPVLVASSAEMAKQFLKVHDANFASRPMLAGGKYTSYNYCDMTWAPYGPYWRQARRIYLNQIFTPKRLDSFEYIRVEERQALISQLNSLAGKPFFLKDHLSRFSLCSMTRMVLSNKYFGESTVRVEDLQYLVDQWFLLNGAFNIGDWIPWLSFLDLQGYVKQMKALKRTFDKFHNIVLDDRRAKKNAEKNFVPKDMVDVLLKMAEDPNLEVKLTNDCVKGLMQDLLTGGTDSLTAAVQWAFQELLRRPRVIEKATEELDRIVGKERWVEEKDCSQLSYVEAILKETLRLHPLGTMLAPHCAIEDCNVAGYDIQKGTTVLVNVWTIGRDPKYWDRAQEFLPERFLENDIDMDGHNFAFLPFGSGRRRCPGYSLGLKVIRVTLANMLHGFNWKLPEGMKPEDISVEEHYGLTTHPKFPVPVILESRLSSDLYSPIT

SEQ ID NO: 248 - DNA, 1591 bp, Nicotiana tabacum
ctcattatccatcacctaaaatggagaattcttgggtttttctagccttggcagggctatctgcattagcttttctctgtaaaataatcacctgtcgaagaccggttaaccggaaaataccaccaggtccaaaaccatggcccatcattggcaatttgaacctacttggtcctataccacatcaatcttttgacttgctttccaaaaaatatggagagttgatgctgctgaaatttggctccaggccagttcttgttgcttcatctgctgaaatggcaaaacagtttttaaaagtacatgatgctaatttcgcctcccgtcctatgctagctggtggaaagtatacaagctataactattgtgacatgacatgggcaccctatggtccctattggcgccaagcacgacgacgaatttaccttaaccagatatttactccgaaaaggctagactcgttcgagtacattcgtgttgaagaaaggcaggccttgatttcccagctgaattcccttgctggaaagccattttttctcaaagaccatttgtcgcgatttagcctctgcagcatgacaaggatggttttgagcaacaagtattttggtgaatcaacagttagagtagaagatttgcagtacctggtagatcaatggttcttacttaatggtgctttcaacattggagattggattccatggctcagcttcttggacctacaaggctatgtgaaacaaatgaaggctttgaaaagaacttttgataagttccacaacattgtgctagatgatcacagggctaagaagaatgcagagaagaactttgtcccaaaagacatggttgatgtcttgttgaagatggctgaagatcctaatctggaagtcaaactcactaatgactgtgtcaaagggttaatgcaggatttactaactggaggaacagatagcttaacagcagcagtgcaatgggcatttcaagaacttcttagacagccaagggttattgagaaggcaaccgaagagcttgaccggattgtcgggaaagagagatgggtagaagagaaagattgctcgcagctatcttacgttgaagcaatcctcaaggaaacactaaggttacatcctctaggaactatgctagcaccgcattgtgctatagaagattgtaacgtggctggttatgacatacagaaaggaacgaccgttctggtgaatgtttggaccattggaagggacccaaaatactgggatagagcacaagagtttctccccgagagattcttagagaacgacattgatatggacggacataactttgctttcttgccatttggctcggggcgaaggaggtgccctggctatagccttggacttaaggttatccgagtaacattagccaacatgttgcatggattcaactggaaattacctgaaggtatgaagccagaagatataagtgtggaagaacattatgggctcactacacatcctaagtttcctgttcctgtgatcttggaatctagactttcttcagatctctattcccccatcacttaatcctaagtgcttcctattatagcatcatatcaatatccctc

SEQ ID NO: 249 - protein, 509 aa, Nicotiana tabacum
MENSWVFLALAGLSALAFLCKIITCRRPVNRKIPPGPKPWPIIGNLNLLGPIPHQSFDLLSKKYGELMLLKFGSRPVLVASSAEMAKQFLKVHDANFASRPMLAGGKYTSYNYCDMTWAPYGPYWRQARRRIYLNQIFTPKRLDSFEYIRVEERQALISQLNSLAGKPFFLKDHLSRFSLCSMTRMVLSNKYFGESTVRVEDLQYLVDQWFLLNGAFNIGDWIPWLSFLDLQGYVKQMKALKRTFDKFHNIVLDDHRAKKNAEKNFVPKDMVDVLLKMAEDPNLEVKLTNDCVKGLMQDLLTGGTDSLTAAVQWAFQELLRQPRVIEKATEELDRIVGKERWVEEKDCSQLSYVEAILKETLRLHPLGTMLAPHCAIEDCNVAGYDIQKGTTVLVNVWTIGRDPKYWDRAQEFLPERFLENDIDMDGHNFAFLPFGSGRRRCPGYSLGLKVIRVTLANMLHGFNWKLPEGMKPEDISVEEHYGLTTHPKFPVPVILESRLSSDLYSPIT

SEQ ID NO: 250 - DNA, 1615 bp, Nicotiana tabacum
tgataatgctctttctactctttgtagcccttcctttcattcttatttttcttcttcctaaattcaaaaatggtggaaataacagattgccaccaggtcctataggtttaccattcattggaaatttgcatcaatacgatagtataactcctcatatctatttttggaaactttcaaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttaatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatttgagtaatttaatgatttcattaacaagtacaattatttgtagagttgcttttggtgttaggattgaagaagaagcacatgcaaggaagagatttgattttcttttggccgaggcacaagaaatgatggctagtttctttgtatctgatttttttccctttttaagttggattgataaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtatcgattacaagggtcaagattttgagttacttccatttggtgcaggcagaagaggttgcccaggtattgcacttggggttgcatccatggaacttgctttgtcaaatcttctttatgcatttgattgggagttgccttatggagtaaaaaaagaagacatcgacacaaacgttaggcctggaattgccatgcacaagaaaaacgaactttgccttgtcccaaaaaattatttataaattatattgggacgtggatctcatgctagttctgtgcggtcagctaagcttattatttttggctcaaattatgtatacataattagtacatgtttaaaatgtataaatatagtagaaccattctcatggtt

SEQ ID NO: 251 - protein, 492 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFNDYWREMRKICVLHLFSLKKVQLFSPIREDEVFRMIKKISKQASTSQIINLSNLMISLTSTIICRVAFGVRIEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFELLPFGAGRRGCPGIALGVASMELALSNLLYAFDWELPYGVKKEDIDTNVRPGIAMHKKNELCLVPKNYL

SEQ ID NO: 252 - DNA, 1624 bp, Nicotiana tabacum
tgataatgctctttctactctttgtagcccttcctttcattcttatttttcttcttcctaaattcaaaaatggtggaaataacagattgccaccaggtcctataggtttaccattcattggaaatttgcatcaatatgatagtataactcctcatatctatttttggaaactttccaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttgcaccttataatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatttgagtaatttaatgatttcattaacaagtacaattatttgtagagttgcttttggtgttaggtttgaagaagaagcacatgcaaggaagagatttgattttcttttggccgaggcacaagaaatgatggctagtttctttgtatctgatttttttccctttttaagttggattgataaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtatcgattacaagggtcaagattttgagttacttccatttggtgcaggcagaagaggttgcccaggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaattatttataaattatattgggacgtggatctcatgctagttctgtgcggtcagctaagcttattatttttggctcaaattatgtatacataattagtacatgtttaaaatgtataaatatagtagaaccattctcatggtt

SEQ ID NO: 253 - protein, 495 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFAPYNDYWREMRKICVLHLFSLKKVQLFSPIREDEVFRMIKKISKQASTSQIINLSNLMISLTSTIICRVAFGVRFEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFELLPFGAGRRGCPGIALGVASMELALSNLLYAFDWELPYGVKKEDIDTNVRPGIAMHKKNELCLVPKNYL

SEQ ID NO: 254 - DNA, 1627 bp, Nicotiana tabacum
aaaattcataatggtttttcccatagaagcctttgtaggactagtaaccttcacatttctcttatacttcctatggacaaaaaaatctcaaaaacttccaaaacccttactaccgaaaatccccggaggatggccggtaatcggccatctttttcacttcaataacgacggcgacgaccgtccattagctcgaaaactcggagacttagctgataaatacggccccgttttcacttttcggctaggtcttccccttgtgctagttgtaagcagttacgaagctataaaagattgcttctctacaaatgacgccattttctccaatcgtccagcttttctttacggcgaataccttggctacaataatacaatgctttttctagcaaattacggaccttactggcgaaaaaatcgtaaattagtcattcaggaagttctctctgctagtcgtctcgaaaaattcaaacaagtgagattcaccagaattcaaacgagcattaagaatttatacactcgaattaatggaaattcgagtacgataaatctaactgattggttagaagaattggattttggtctgatcgtgaaaatgatcgctgggaaaaattatgaatccggtaaaggagatgaacaagtggaaagatttaagaatgcgtttaaggattttatggttttatcaatggaatttgtattatgggatgcatttccaattccattatttaaatgggtggattttcaaggtcatattaaggcaatgaaaaggacatttaaggatatagattctgtttttcagaactggttagaggaacatattaataaaagagaaaaaatggaggttggtgcagaagggaatgaacaagatttcattgatgtggtgctttcaaaattgagtaaagaatatcttgatgaaggttactctcgtgatactgtcattaaagcaacagtttttagtttggtcttggatgcagcagacacagttgctcttcacataaattggggaatgacattattgataaacaatcaaaatgccttgatgaaagcacaagaagagatagacacaaaagttggtaagtatagatgggtagaagagagtgatattaaggatttagtatacctccaagctattgttaaaaaggtgttacgattatatccaccaggacctttgttagtaccacatgaatatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatatcgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccggtggaattgataataacgcctcgcttggcacctgagctttactaaaacctaagatctttcatcttggttgatcattgtttaatactcctagatagatgggtattcatc

SEQ ID NO: 255 - protein, 517 aa, Nicotiana tabacum
MVFPIEAFVGLVTFTFLLYFLWTKKSQKLPKPLLPKIPGGWPVIGHLFHFNNDGDDRPLARKLGDLADKYGPVFTFRLGLPLVLVVSSYEAIKDCFSTNDAIFSNRPAFLYGEYLGYNNTMLFLANYGPYWRKNRKLVIQEVLSASRLEKFKQVRFTRIQTSIKNLYTRINGNSSTINLTDWLEELDFGLIVKMIAGKNYESGKGDEQVERFKNAFKDFMVLSMEFVLWDAFPIPLFKWVDFQGHIKAMKRTFKDIDSVFQNWLEEHINKREKMEVGAEGNEQDFIDVVLSKLSKEYLDEGYSRDTVIKATVFSLVLDAADTVALHINWGMTLLINNQNALMKAQEEIDTKVGKYRWVEESDIKDLVYLQAIVKKVLRLYPPGPLLVPHEYVKDCVVSGYHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 256 - DNA, 1594 bp, Nicotiana tabacum
caaaaaatcatttctctcgtctaaaatggatcttctcttactagagaagaccttaattggtcttttctttgccattttaatcgctttaattgtctctaaacttcgttcaaagcgttttaagcttcctccaggaccaattccagtaccagtttttggtaattggcttcaagttggtgatgatttaaaccacagaaatcttactgattatgccaaaaaatttggcgatcttttcttgttaagaatgggtcaacgtaacttagttgttgtgtcatctcctgaattagctaaagaagttttacacacacaaggtgttgaatttggttcaagaacaagaaatgttgtgtttgatatttttactggaaaaggtcaagatatggtttttactgtatatggtgaacattggagaaaaatgaggagaattatgactgtaccattttttactaataaagttgtgcaacagtatagaggggggtgggagtttgaggtggcaagtgtaattgaggatgtgaaaaaaaatcctgaatctgctactaatgggatcgtattaaggaggagattacaattaatgatgtataataatatgtttaggattatgtttgataggagatttgagagtgaagatgatcctttgtttgttaagcttaaggctttgaatggtgaaaggagtagattggctcaaagttttgagtataattatggtgattttattccaattttgaggcctcttttgagaggttatttgaagatctgtaaagaagttaaggagaagaggctgcagcttttcaaagattactttgttgatgaaagaaagaagctttcaaataccaagagctcggacagcaatgccctaaaatgtgcgattgatcacattcttgaggctcaacagaagggagagatcaatgaggacaacgttctttacattgttgaaaacatcaatgttgctgcaattgaaacaacattatggtcaattgagtggggtatcgccgagctagtcaaccaccctcacatccaaaagaaactgcgcgacgagattgacacagttcttggaccaggagtgcaagtgactgaaccagacacccacaagcttccataccttcaggctgtgatcaaggaggcacttcgtctccgtatggcaattcctctattagtcccacacatgaaccttcacgacgcaaagcttggcgggcttgatattccagcagagagcaaaatcttggttaacgcttggtggttagctaacaacccggctcattggaagaaacccgaagagttcagacccgagaggttctttgaagaggagaagcatgttgaggccaatggcaatgacttcagatatcttccgtttggcgttggtaggaggagctgccctggaattatacttgcattgccaattcttggcatcactttgggacgtttggttcagaactttgagctgttgcctcctccaggccagtcgaagctcgacaccacagagaaaggtggacagttcagtctccacattttgaagcattccaccattgtgttgaaaccaaggtctttctgaactttgtgatcttattaattaaggggttctgaagaaatttgatagtgttgg

SEQ ID NO: 257 - protein, 505 aa, Nicotiana tabacum
MDLLLLEKTLIGLFFAILIALIVSKLRSKRFKLPPGPIPVPVFGNWLQVGDDLNHRNLTDYAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPLLRGYLKICKEVKEKRLQLFKDYFVDERKKLSNTKSSDSNALKCAIDHILEAQQKGEINEDNVLYIVENINVAAIETTLWSIEWGIAELVNHPHIQKKLRDEIDTVLGPGVQVTEPDTHKLPYLQAVIKEALRLRMAIPLLVPHMNLHDAKLGGLDIPAESKILVNAWWLANNPAHWKKPEEFRPERFFEEEKHVEANGNDFRYLPFGVGRRSCPGIILALPILGITLGRLVQNFELLPPPGQSKLDTTEKGGQFSLHILKHSTIVLKPRSF

SEQ ID NO: 258 - DNA, 1678 bp, Nicotiana tabacum
aacattttgcaatatagttttcctagtcagttctagcctccttttccttagaaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttcgctgcccgaccaacttctatggctggtgaaagcatcgggtacaagtatgcgaggtttacttatgctaattttggtccttattataaccaagtgcgcaaactagccctacaacatgtaccctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgatcctgaaatttggtcagagcccgaaaagtttatgcccaatagattcttgactagcaaagcaaatatagatgctcgcggtcaaaattttgaatttataccgtttggttctgggagacggtcatgtccagggataggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttattttgaaagtgcaaatcatcaatcatggcttgagtaattagttatactttaatatgtttctc

SEQ ID NO: 259 - protein, 521 aa, Nicotiana tabacum
MDYHISFHFQALLGLLAFVFLSIILWRRTLTSRKLAPEIPGAWPIIGHLRQLSGTDKNIPFPRILGALADKYGPVFTLRIGMYPYLIVNNWEAAKDCLTTHDKDFAARPTSMAGESIGYKYARFTYANFGPYYNQVRKLALQHVPSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIEDTDIKNLVYLQAIVKETLRLYPPVPFLLPHEAVQDCKVTGYHIPKGTRLYINAWKVHRDPEIWSEPEKFMPNRFLTSKANIDARGQNFEFIPFGSGRRSCPGIGFATLVTHLTFGRLLQGFDFSKPSNTPIDMTEGVGVTLPKVNQVEVLITPRLPSKLYLF

SEQ ID NO: 260 - DNA, 1537 bp, Nicotiana tabacum
tgataatgctctttctactctttgtagcccttcctttcattcttatttttcttcttcctaaattcaaaaatggtggaaataacagattgccaccaggtcctataggtttaccattcattggaaatttgcatcaatatgatagtataactcctcatatctatttttggaaactttccaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttgcaccttataatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatttgagtaatttaatgatttcattaacaagtacaattatttgtagagttgcttttggtgttaggtttgaagaagaagcacatgcaaggaagagatttgattttcttttggccgaggcacaagaaatgatggctagtttctttgtatctgatttttttccctttttaagttggattgataaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtaccgattacaagggtcaagattttgagttacttccatttggtgcaggcagaagaggttgcccaggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaattatttataaattatattgggacgtggatctcaatttagttctgtgaggtcagc

SEQ ID NO: 261 - protein, 495 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFAPYNDYWREMRKICVLHLFSLKKVQLFSPIREDEVFRMIKKISKQASTSQIINLSNLMISLTSTIICRVAFGVRFEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSTDYKGQDFELLPFGAGRRGCPGIALGVASMELALSNLLYAFDWELPYGVKKEDIDTNVRPGIAMHKKNELCLVPKNYL

SEQ ID NO: 262 - DNA, 1572 bp, Nicotiana tabacum
ccaaaatcatggctctatctttcatattcatatccataaccctaatttttctagttcataaactctaccaccgtcttagattcaaactaccaccaggtccgcggccgttaccggtggtcggaaacctctacgacataaaaccggtgagattccggtgctttgccgattgggccaaaacttacggtccgattttctcagtatactttgggtcacagttaaatgttgtggtaacaacagctgaattagctaaagaagtattgaaagaaaatgaccagaatttagcagatagatttaggactagacctgcaaataatttgagcagaaatgggatggatttgatttgggctgattatgggcctcattatgtgaaagtaaggaagctctgtaatcttgagctttttactcctaaaagacttgaagctcttagacctattagagaagatgaagttactgctatggttgaaaacattttcaaggattgtactaagcctgataacacaggtaaaagcttgttgataagagagtacttaggatcagtagcattcaacaacattacaaggttaacatttgggaaaaggttcatgaactcaaaaggtgagattgatgagcaaggtcaagaattcaagggtattgtctctaatggcatcaaaattggcggaaaacttcccttggcagagtatgttccatggctccgttggtttttcacaatggaaaacgaggcactcgtgaagcactctgcacgtagagaccggttaacaagaatgatcatggatgaacacacactggctcgcaagaaaactggtgatactaagcagcattttgtcgatgcattgcttactcttcagaagcagtatgatcttagtgatgacactgttattggcctcctctgggatatgattacagcaggaatggacacaacaaccataacagtggaatgggcaatggcagaactagttaagaacccaagagtgcaactaaaagctcaagaggagcttgacagggtaatcggaacggatcgaatcatgtcagaaaccgatttctctaaacttccttacctacaatgtgtagccaaagaggctctaaggttgcaccctccaactcctctaatgcttcctcataaggccagtgccagtgtcaaaattggtggttatgacattcctaaggggtccatcgtgcacgtgaacgtttgggctgtcgctcgtgacccagccgtgtggaagaacccgttggagttcagaccagagcgcttccttgaggaagacgttgacatgaagggtcacgactatcggttattgccctttggtgcaggaaggcgtgtttgccccggtgcacaacttgctatcaacttggtcacatctatgttgggtcatttgttgcatcattttacatgggctccggccccgggggttaacccggaggatattgacttggaggagagccctggaacagtaacttacatgaaaaatccaatacaagctattccaactccaagattgcctgcacacttgtatggacgtgtgccagtggatatgtaaaacattttgttctttccctttttggttatatgatgag

SEQ ID NO: 263 - protein, 508 aa, Nicotiana tabacum
MALSFIFISITLIFLVHKLYHRLRFKLPPGPRPLPVVGNLYDIKPVRFRCFADWAKTYGPIFSVYFGSQLNVVVTTAELAKEVLKENDQNLADRFRTRPANNLSRNGMDLIWADYGPHYVKVRKLCNLELFTPKRLEALRPIREDEVTAMVENIFKDCTKPDNTGKSLLIREYLGSVAFNNITRLTFGKRFMNSKGEIDEQGQEFKGIVSNGIKIGGKLPLAEYVPWLRWFFTMENEALVKHSARRDRLTRMIMDEHTLARKKTGDTKQHFVDALLTLQKQYDLSDDTVIGLLWDMITAGMDTTTITVEWAMAELVKNPRVQLKAQEELDRVIGTDRIMSETDFSKLPYLQCVAKEALRLHPPTPLMLPHKASASVKIGGYDIPKGSIVHVNVWAVARDPAVWKNPLEFRPERFLEEDVDMKGHDYRLLPFGAGRRVCPGAQLAINLVTSMLGHLLHHFTWAPAPGVNPEDIDLEESPGTVTYMKNPIQAIPTPRLPAHLYGRVPVDM

SEQ ID NO: 264 - DNA, 1580 bp, Nicotiana tabacum
aatcactaattttcatgtactctcataggtcaaaagtttcaaccaaaatcatggctctatccttcatattcatatccataaccctaatttttctagttcataaactctaccaccgtcttagattcaaactaccaccaggtccgcggccgttaccggtggtcggaaacctctacgacatagaaccggtgagattccggtgctttgccgattgggccaaaacttacggtccgattttctcagtatactttgggtcacagttaaatgttgtggtaacaacagctgaattagctaaagaagtattgaaagaaaatgaccagaatttagcagatagatttaggactagacctgcaaataatttgagcagaaatgggatggatttgatttgggctgattatgggcctcattatgtgaaagtaaggaagctctgtaatcttgagctttttactcctaaaagacttgaagctcttagacctattagagaagatgaagttactgctatggttgaaaacattttcaaggattgtactaagcctgataacacaggtaaaagcttgttgataagagagtacttaggatcagtagcattcaacaacattacaaggttaacatttgggaaaaggttcatgaactcaaaaggtgagattgatgagcaaggtcaagaattcaagggtattgtctctaatggcatcaaaattggcggaaaacttcccttggcagagtatgttccatggctccgttggtttttcacaatggaaaacgaggcactcgtgaagcactctgcacgtagagaccggttaacaagaatgatcatggatgaacacacactggctcgcaagaaaactggtgatactaagcagcattttgtcgatgcattgcttactcttcagaagcagtatgatcttagtgatgacactgttattggcctcctctgggatatgattacagcaggaatggacacaacaaccataacagtggaatgggcaatggcagaactagttaagaacccaagagtgcaactaaaagctcaagaggagcttgacagggtaatcggaacggatcgaatcatgtcagaaaccgatttctctaaacttccttacctacaatgtgtagccaaagaggctctaaggttgcaccctccaactcctctaatgcttcctcatagggccagtgccagtgtcaaaattggtggttatgacattcctaaggggtccatcgtgcacgtgaacgtttgggctgtcgctcgtgacccagccgtgtggaagaacccgttggagttcagaccagagcgcttccttgaggaagacgttgacatgaagggtcacgactatcggttattgccctttggtgcaggaaggcgtgtttgccccggtgcacaacttgctatcaacttggtcacatctatgttgggtcatttgttgcatcattttacatgggctccggccccgggggttaacccggaggatattgacttggaggagagccctggaacagtaacttacatgaaaaatccaatacaagctattccaactccaagattgcctgcacacttgtatggacgtgtgccagtggatatgtaaaac

SEQ ID NO: 265 - protein, 520 aa, Nicotiana tabacum
MYSHRSKVSTKIMALSFIFISITLIFLVHKLYHRLRFKLPPGPRPLPVVGNLYDIEPVRFRCFADWAKTYGPIFSVYFGSQLNVVVTTAELAKEVLKENDQNLADRFRTRPANNLSRNGMDLIWADYGPHYVKVRKLCNLELFTPKRLEALRPIREDEVTAMVENIFKDCTKPDNTGKSLLIREYLGSVAFNNITRLTFGKRFMNSKGEIDEQGQEFKGIVSNGIKIGGKLPLAEYVPWLRWFFTMENEALVKHSARRDRLTRMIMDEHTLARKKTGDTKQHFVDALLTLQKQYDLSDDTVIGLLWDMITAGMDTTTITVEWAMAELVKNPRVQLKAQEELDRVIGTDRIMSETDFSKLPYLQCVAKEALRLHPPTPLMLPHRASASVKIGGYDIPKGSIVHVNVWAVARDPAVWKNPLEFRPERFLEEDVDMKGHDYRLLPFGAGRRVCPGAQLAINLVTSMLGHLLHHFTWAPAPGVNPEDIDLEESPGTVTYMKNPIQAIPTPRLPAHLYGRVPVDM

SEQ ID NO: 266 - DNA, 1544 bp, Nicotiana tabacum
ataatgctctttctactctttgtagcccttcctttcattcttatttttcttcttcctaaattcaaaaatggtggaaataacagattgccaccaggtcctataggtttaccattcattggaaatttgcatcaatatgatagtataactcctcatatctatttttggaaactttccaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttgcaccttataatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatttgagtaatttaatgatttcattaacaagtacaattatttgtagagttgcttttggtgttaggtttgaagaagaagcacatgcaaggaagagatttgattttcttttggccgaggcacaagaaatgatggctagtttctttgtatctgatttttttccctttttaagttagattgacaaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtatcgattacaagggtcaagattttgagttacttccatttggtgcaggcagaagaggttgcccaggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaaattatttataaattatattgggacgtggatctcatgctagttctgtgcggtcagctaagctta

SEQ ID NO: 267 - protein, 223 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFAPYNDYWREMRKICVLHLFSLKKVQLFSPIREDEVFRMIKKISKQASTSQIINLSNLMISLTSTIICRVAFGVRFEEEAHARKRFDFLLAEAQEMMASFFVSDFFPFLS

SEQ ID NO: 268 - DNA, 1615 bp, Nicotiana tabacum
cacattgagtcctctcccaaatcactgattcaccaccaaaagtaccaacaattcaatggaaggtacaaacttgactacatatgcagcagtatttcttgatactctgtttcttttgttcctttccaaacttcttcgccagaggaaactcaatttacctccaggcccaaaaccatggccgatcatcggaaacttaaaccttattggcaatcttcctcatcgctcaatccacgaactctccctcaagtacggacccgttatgcaactccaattcgggtctttccccgttgtagttggatcctccgtcgaaatggctaagattttcctcaaatccatggatattaactttgtaggcaggcctaaaacggctgccggaaaatacacaacgtacaattattccgatattacatggtctccttacggaccatattggcgccaggcacgtaggatgtgcctaacggaattattcagcacgaaacgtctcgattcatacgagtatattcgggctgaggagttgcattctcttctccataatttgaacaaaatatcagggaaaccaattgtgttgaaagattatttgacgacgttgagtttaaatgttattagcaggatggtactggggaaaaggtatttggacgaatccgagaactcgttcgtgaatcctgaggaatttaagaagatgttggacgaattgtttttgctaaatggtgtacttaatattggagattcaattccatggattgatttcatggatttgcaaggttatgttaagaggatgaaagtagtgagcaagaaattcgacaagtttttagagcatgttattgatgagcataacattaggagaaatggagtggagaattatgttgctaaggatatggtggatgttttgttgcagcttgctgatgatccgaagttggaagttaagctggagagacatggagtcaaagcattcactcaggatatgctggctggtggaaccgagagttcagcagtgacagtggagtgggcaatttcagagctgctaaagaagccggagattttcaaaaaggctacagaagaattggatcgagtaattgggcagaatagatgggtacaagaaaaggacattccaaatcttccttacatagaggcaatagtcaaagagactatgcgactgcaccccgtggcaccaatgttggtgccacgtgagtgtcgagaagatattaaggtagcaggctacgacgttcagaaaggaactagggttctcgtgagtgtatggactattggaagagaccctacattgtgggacgagcctgaggtgttcaagccggagagattccatgaaaagtccatagatgttaaaggacatgattatgagcttttgccatttggagcggggagaagaatgtgcccgggttatagcttggggctcaaggtgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttgattcagcagttctatggttccgtcaagatag

SEQ ID NO: 269 - protein, 509 aa, Nicotiana tabacum
MEGTNLTTYAAVFLDTLFLLFLSKLLRQRKLNLPPGPKPWPIIGNLNLIGNLPHRSIHELSLKYGPVMQLQFGSFPVVVGSSVEMAKIFLKSMDINFVGRPKTAAGKYTTYNYSDITWSPYGPYWRQARRMCLTELFSTKRLDSYEYIRAEELHSLLHNLNKISGKPIVLKDYLTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMVDVLLQLADDPKLEVKLERHGVKAFTQDMLAGGTESSAVTVEWAISELLKKPEIFKKATEELDRVIGQNRWVQEKDIPNLPYIEAIVKETMRLHPVAPMLVPRECREDIKVAGYDVQKGTRVLVSVWTIGRDPTLWDEPEVFKPERFHEKSIDVKGHDYELLPFGAGRRMCPGYSLGLKVIQASLANLLHGFNWSLPDNMTPEDLNMDEIFGLSTPKKFPLATVIEPRLSPKLYSV

SEQ ID NO: 270 - DNA, 1610 bp, Nicotiana tabacum; identical to SEQ ID NO: 206

SEQ ID NO: 271 - protein, 503 aa, Nicotiana tabacum; identical to SEQ ID NO: 207

SEQ ID NO: 272 - DNA, 1611 bp, Nicotiana tabacum
ctttcatcatatggcatgaaatgggaaatgctcacaacagcaaaattgcagcaatctgtttgataattttcttggtatataaagcatgggaattgttgaagtggatatggattaagccaaagaaactggagagttgcctcagaaaacagggactcaaaggaaattcctacgggctattctatggagatatgaaagaattgtccaaaagtctcaaggaaatcaattcaaagcccatcatcaatctatcaaatgaagtagccccaagaatcattccttattatcttgaaatcatccaaaaatatggtaaaagatgttttgtttggcaaggaccaacccccgcaatattaataacagagccagaattaataaaggagatatttggtaagaactatgtttttcagaagcctaataatcccaacccactgaccaagttattggctcgaggtgttgtaagctacgaggaagaaaaatgggcaaaacacagaaagatcttaaatcctgcctttcatatggagaagttgaagcatatgctaccagcattttacttgagctgtagtgagatgctgaacaaatgggaggagattatcccagtaaaagaatcaaatgagttggacatttggcctcatcttcaaagaatgacaagtgatgtgatttctcgtgctgcctttggtagtagctacgaagaaggaagaagaatatttgaacttcaagaagaacaagctgagtatctaacgaagacattcaattcagtttatatcccaggttccagattttttcccaataaaatgaacaaaagaatgaaagaatgtgaaaaggaagtacgagaaacaattacgtgtctaattgacaacagattaaaggcaaaagaagaaggcaatggcaaggccctcaatgatgacctattgggtatattattagagtcaaattctatagaaattgaagaacatggtaacaagaagtttggaatgagtatacctgaagtaattgaagagtgcaaattattctattttgctggccaagagactacatcagtattgcttgtgtggacactgattttgttagggagaaatccagaatggcaggaacgtgctagagaggaagtttttcaagcctttggaagtgataaaccaacttttgacgaattatatcgcttgaaaattgtgacgatgattttgtacgagtctttaaggttatatccaccaatagcaactcgtactcgaaggactaatgaagaaacaaaattaggggaactagatttaccaaagggtgcactgctctttataccaacaatcttattacatcttgacagggaaatttggggtgaagatgcagatgagttcaatccggagagatttagcgaaggggtggcaaaggcaacaaaggggaaaatgacatattttccatttggtgcaggaccgcgaaaatgcattgggcaaaacttcgcgattttggaagcaaaaatggctatagctatgattctacaacgcttctccttcgagctctctccatcttatacacactctccatacactgtggtcactttgaaacccaaatatggtgctcccctaataatgcacaggctgtagtcctgtgagaatatgctatccgagg

SEQ ID NO: 273 - protein, 521 aa, Nicotiana tabacum
MGNAHNSKIAAICLIIFLVYKAWELLKWIWIKPKKLESCLRKQGLKGNSYGLFYGDMKELSKSLKEINSKPIINLSNEVAPRIIPYYLEIIQKYGKRCFVWQGPTPAILITEPELIKEIFGKNYVFQKPNNPNPLTKLLARGVVSYEEEKWAKHRKILNPAFHMEKLKHMLPAFYLSCSEMLNKWEEIIPVKESNELDIWPHLQRMTSDVISRAAFGSSYEEGRRIFELQEEQAEYLTKTFNSVYIPGSRFFPNKMNKRMKECEKEVRETITCLIDNRLKAKEEGNGKALNDDLLGILLESNSIEIEEHGNKKFGMSIPEVIEECKLFYFAGQETTSVLLVWTLILLGRNPEWQERAREEVFQAFGSDKPTFDELYRLKIVTMILYESLRLYPPIATRTRRTNEETKLGELDLPKGALLFIPTILLHLDREIWGEDADEFNPERFSEGVAKATKGKMTYFPFGAGPRKCIGQNFAILEAKMAIAMILQRFSFELSPSYTHSPYTVVTLKPKYGAPLIMHRL

SEQ ID NO: 274 - DNA, 1570 bp, Nicotiana tabacum
ctcattatccatcacctaaaatggagaattcttgggtttttctagccttggcagggctatctgcattagcttttctctgtaaaataatcacctgtcgaagaccggttaaccggaaaataccaccaggtccaaaaccatggcccatcattggcaatttgaacctacttggtcctataccacatcaatcttttgacttgctttccaaaaaatatggagagttgatgctgctgaaatttggctccaggccagttcttgttgcttcatctgctgaaatggcaaaacagtttttaaaagtacatgatgctaatttcgcctcccgtcctatgctagctggtggaaagtatacaagctataactattgtgacatgacatgggcaccctatggtccctattggcgccaagcacgacgaatttaccttaaccagatatttactccgaaaaggctagactcgttcgagtacattcgtgttgaagaaaggcaggccttgatttcccagctgaattcccttgctggaaagccattttttctcaaagaccatttgtcgcgatttagcctctgcagcatgacaaggatggttttgagcaacaagtattttggtgaatcaacagttagagtagaagatttgcagtacctggtagatcaatggttcttacttaatggtgctttcaacattggagattggattccatggctcagcttcttggacctacaaggctatgtgaaacaaatgaaggctttgaaaagaacttttgataagttccacaacattgtgctagatgatcacagggctaagaagaatgcagagaagaactttgtcccaaaagacatggttgatgtcttgttgaagatggctgaagatcctaatctggaagtcaaactcactaatgactgtgtcaaagggttaatgcaggatttactaactggaggaacagatagcttaacagcagcagtgcaatgggcatttcaagaacttcttagacagccaagggttattgagaaggcaaccgaagagcttgaccggattgtcgggaaagagagatgggtagaagagaaagattgctcgcagctatcttacgttgaagcaatcctcaaggaaacactaaggttacatcctctaggaactatgctagcaccgcattgtgctatagaagattgtaacgtggctggttatgacatacagaaaggaacgacctttctggtgaatgtttggaccattggaagggacccaaaatactgggatagagcacaagagtttctccccgagagatttttagagaacgacattgatatggacggacataactttgctttcttgccatttggctcggggcgaaggaggtgccctggctatagccttggacttaaggttatccgagtaacattagccaacatgttgcatggattcaactggaaattacctgaaggtatgaagccagaagatataagtgtggaagaacattatgggctcactacacatcctaagtttcctgttcctgtgatcttggaatctagactttcttcagatctctattcccccatcacttaatcctaagtgcttcctattatagc

SEQ ID NO: 275 - protein, 508 aa, Nicotiana tabacum
MENSWVFLALAGLSALAFLCKIITCRRPVNRKIPPGPKPWPIIGNLNLLGPIPHQSFDLLSKKYGELMLLKFGSRPVLVASSAEMAKQFLKVHDANFASRPMLAGGKYTSYNYCDMTWAPYGPYWRQARRIYLNQIFTPKRLDSFEYIRVEERQALISQLNSLAGKPFFLKDHLSRFSLCSMTRMVLSNKYFGESTVRVEDLQYLVDQWFLLNGAFNIGDWIPWLSFLDLQGYVKQMKALKRTFDKFHNIVLDDHRAKKNAEKNFVPKDMVDVLLKMAEDPNLEVKLTNDCVKGLMQDLLTGGTDSLTAAVQWAFQELLRQPRVIEKATEELDRIVGKERWVEEKDCSQLSYVEAILKETLRLHPLGTMLAPHCAIEDCNVAGYDIQKGTTFLVNVWTIGRDPKYWDRAQEFLPERFLENDIDMDGHNFAFLPFGSGRRRCPGYSLGLKVIRVTLANMLHGFNWKLPEGMKPEDISVEEHYGLTTHPKFPVPVILESRLSSDLYSPIT

SEQ ID NO: 276 - DNA, 1617 bp, Nicotiana tabacum
cacattgagtcctctcccaaatcactgattcaccaccaaaagtaccaacaattcaatggaaggtacaaacttgactacatatgcagcagtatttcttgatactctgtttcttttgttcctttccaaacttcttcgccagaggaaactcaatttacctccaggcccaaaaccatggccgatcatcggaaacttaaaccttattggcaatcttcctcatcgctcaatccacgaactctccctcaagtacggacccgttatgcaactccaattcgggtctttccccgttgtagttggatcctccgtcgaaatggctaagattttcctcaaatccatggatattaactttgtaggcaggcctaaaacggctgccggaaaatacacaacgtacaattattccgatattacatggtctccttacggaccatattggcgccaggcacgtaggatgtgcctaacggaattattcagcacgaaacgtctcgattcatacgagtatattcgggctgaggagttgcattctcttctccataatttgaacaaaatatcagggaaaccaattgtgttgaaagattatttgacgacgttgagtttaaatgttattagcaggatggtactggggaaaaggtatttggacgaatccgagaactcgttcgtgaatcctgaggaatttaagaagatgttggacgaattgtttttgctaaatggtgtacttaatattggagattcaattccatggattgatttcatggatttgcaaggttatgttaagaggatgaaagtagtgagcaagaaattcgacaagtttttagagcatgttattgatgagcataacattaggagaaatggagtggagaattatgttgctaaggatatggtggatgttttgttgcagcttgctgatgatccgaagttggaagttaagctggagagacatggagtcaaagcattcactcaggatatgctggctggtggaaccgagagttcagcagtgacagtggagtgggcaatttcagagctgctaaagaagccggagattttcaaaaaggctacagaagaattggatcgagtaattgggcagaatagatgggtacaagaaaaggacattccaaatcatccttacatagaggcaatagtcaaagagactatgcgactgcaccccgtggcaccaatgttggtgccacgtgagtgtcgagaagatattaaggtagcaggctacgacgttcagaaaggaactagggttctcgtgagtgtatggactattggaagagaccctacattgtgggacgagcctgaggtgttcaagccggagagattccatgaaaagtccatagatgttaaaggacatgattatgagcttttgccatttggagcggggagaagaatgtgcccgggttatagcttggggctcaaggtgattcaagctagcttagctaatcttctacatggatttaactggtcattgcctgataatatgactcctgaggacctcaacatggatgagatttttgggctctctacacctaaaaaatttccacttgctactgtgattgagccaagactttcaccaaaactttactctgtttgattcagcagttctatggatccgtcaagatagac

SEQ ID NO: 277 - protein, 509 aa, Nicotiana tabacum
MEGTNLTTYAAVFLDTLFLLFLSKLLRQRKLNLPPGPKPWPIIGNLNLIGNLPHRSIHELSLKYGPVMQLQFGSFPVVVGSSVEMAKIFLKSMDINFVGRPKTAAGKYTTYNYSDITWSPYGPYWRQARRMCLTELFSTKRLDSYEYIRAEELHSLLHNLNKISGKPIVLKDYLTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMVDVLLQLADDPKLEVKLERHGVKAFTQDMLAGGTESSAVTVEWAISELLKKPEIFKKATEELDRVIGQNRWVQEKDIPNHPYIEAIVKETMRLHPVAPMLVPRECREDIKVAGYDVQKGTRVLVSVWTIGRDPTLWDEPEVFKPERFHEKSIDVKGHDYELLPFGAGRRMCPGYSLGLKVIQASLANLLHGFNWSLPDNMTPEDLNMDEIFGLSTPKKFPLATVIEPRLSPKLYSV

SEQ ID NO: 278 - DNA, 1657 bp, Nicotiana tabacum
tgcaatatagttttcctagtcagttctagcctccttttccttagaaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttcgctgcccgaccaacttctatggctggtgaaagcatcgggtacaagtatgcgaggtttacttatgctaattttggtccttattataaccaagtgcgcaaactagccctacaacatgtactctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgattctgaaatttggtcagagcccgaaaagtttatgcccaatagattcttgactagcaaagcaaatatagatgctcgcggtcaaaattttgaatttataccgtttggttctgggagacggtcatgtccagggttaggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttattttgaaagtgcaaatcatcaatcatgggttgagtaattagtgatact

SEQ ID NO: 279 - protein, 521 aa, Nicotiana tabacum
MDYHISFHFQALLGLLAFVFLSIILWRRTLTSRKLAPEIPGAWPIIGHLRQLSGTDKNIPFPRILGALADKYGPVFTLRIGMYPYLIVNNWEAAKDCLTTHDKDFAARPTSMAGESIGYKYARFTYANFGPYYNQVRKLALQHVLSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIEDTDIKNLVYLQAIVKETLRLYPPVPFLLPHEAVQDCKVTGYHIPKGTRLYINAWKVHRDSEIWSEPEKFMPNRFLTSKANIDARGQNFEFIPFGSGRRSCPGLGFATLVTHLTFGRLLQGFDFSKPSNTPIDMTEGVGVTLPKVNQVEVLITPRLPSKLYLF

SEQ ID NO: 280 - DNA, 1620 bp, Nicotiana tabacum
agagagtgaaaatggacgcactacttcaaatgacagtaacagcatcttgtgctgccatagtaattactctgctggtgtgtatatggagagtgctgaactggatttggttcagaccaaagaaattggagttgttgttgagaaaacaaggtttggaaggaaattcttacaaggttttgtatggggacatgaaagagttttctgggatgattaaggaagcatactcaaagcctatgagtctatctgatgatgtagcaccaagactgatgcctttctttcttgaaaccatcaaaaaatatggaaaaagatcctttatatggtttggtccaagaccactagtattgattatggatcctgagcttataaaggaagtactctcaaaaatccatctgtatcaaaagcctggtggaaatccattagcaacactattggtacaaggaatagcaacctatgaggaagacaaatgggccaaacatagaaaaatcatcaatcccgctttccatctagagaagctaaagcttatgcttccagcatttcgcttaagctgtagtgagatgctgagcaaatgggaagacattgtttcagctgatagctcacatgagatagatgtatggtctcaccttgagcaattgacttgcgatgtgatctctcggacagcttttggcagtagttatgaagaaggtagaaagatttttgaacttcaaaaggaacaagctcagtatcttgtggaagttttccgctccgtttatatcccaggaaggagatttttgccaacaaagaggaatagaagaatgaaggaaataaaaaaggatgtccgggcatcaattaaaggtattattgataaaagattgaaggcaatgaaagcaggggacaccaataatgaggatctattgggtatattactggaatcgaatattaaagaaattgaacagcacggaaacaaggattttggaatgagcattgaagaagtcattgaagaatgcaagttattctattttgctggccaagaaactacatcagtgttactcctatggtctctagtgttgttgagcaggtatcaagattggcaggcacgggccagagaagaaatcttgcaagtctttggcagtcgaaaaccagattttgacggattaaatcatctaaaaattgtgacaatgatcttgtacgagtctttaaggctgtatccctcactaataacacttacccgccggtgtaatgaagacattgtattaggagaactatctctaccagctggtgttctagtctctttgccattgattttgttgcatcatgatgaagagatatggggtgaagatgcaaaggagttcaaaccagagagatttagagaaggaatatcaagtgcaacaaagggtcaactcacatattttccatttagctggggtcctagaatatgtattggacaaaattttgccatgttagaagcaaagatggctctgtctatgatcctgcaacgcttctcttttgaactgtctccgtcttatgcacatgcccctcggtccataataaccgttcagcctcagtatggtgctccacttattttccacaaactataattttggtacttctactaatattttagggtttattcagactcaaaaaaaa

SEQ ID NO: 281 - protein, 513 aa, Nicotiana tabacum
MTVTASCAAIVITLLVCIWRVLNWIWFRPKKLELLLRKQGLEGNSYKVLYGDMKEFSGMIKEAYSKPMSLSDDVAPRLMPFFLETIKKYGKRSFIWFGPRPLVLIMDPELIKEVLSKIHLYQKPGGNPLATLLVQGIATYEEDKWAKHRKIINPAFHLEKLKLMLPAFRLSCSEMLSKWEDIVSADSSHEIDVWSHLEQLTCDVISRTAFGSSYEEGRKIFELQKEQAQYLVEVFRSVYIPGRRFLPTKRNRRMKEIKKDVRASIKGIIDKRLKAMKAGDTNNEDLLGILLESNIKEIEQHGNKDFGMSIEEVIEECKLFYFAGQETTSVLLLWSLVLLSRYQDWQARAREEILQVFGSRKPDFDGLNHLKIVTMILYESLRLYPSLITLTRRCNEDIVLGELSLPAGVLVSLPLILLHHDEEIWGEDAKEFKPERFREGISSATKGQLTYFPFSWGPRICIGQNFAMLEAKMALSMILQRFSFELSPSYAHAPRSIITVQPQYGAPLIFHKL

SEQ ID NO: 282 - DNA, 1671 bp, Nicotiana tabacum
tgcaatatagttttcctagtcagttctagcctccttttccttagaaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttggctgcccgaccaacttctatggctggtgaaagcatcgggtacaagtatgcgaggtttacttatgctaattttggtccttattataaccaagtgcgcaaactagccctacaacatgtactctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgatcctgaaatttggtcagagcccgaaaagtttatgcccaatagattcttgactagcaaagcaaatatagatgctcgcggtcaaaattttgaatttataccgtttggttctgggagacggtcatgtccagggataggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttattttgaaggtgcaaatcatcaatcatggcttgagtaattagttatactttaatatgtttctc

SEQ ID NO: 283 - protein, 521 aa, Nicotiana tabacum
MDYHISFHFQALLGLLAFVFLSIILWRRTLTSRKLAPEIPGAWPIIGHLRQLSGTDKNIPFPRILGALADKYGPVFTLRIGMYPYLIVNNWEAAKDCLTTHDKDLAARPTSMAGESIGYKYARFTYANFGPYYNQVRKLALQHVLSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIEDTDIKNLVYLQAIVKETLRLYPPVPFLLPHEAVQDCKVTGYHIPKGTRLYINAWKVHRDPEIWSEPEKFMPNRFLTSKANIDARGQNFEFIPFGSGRRSCPGIGFATLVTHLTFGRLLQGFDFSKPSNTPIDMTEGVGVTLPKVNQVEVLITPRLPSKLYLF

SEQ ID NO: 284 - DNA, 1618 bp, Nicotiana tabacum
tttgattcaaccatggagaaccaatactcctactcattctcttcctacttctacttagctatagtactgtttcttcttccaattttggtcaaatatttcttccatcggagaagaaatttacctccaagtccattttctcttccaataattggtcacctttaccttctcaagaaaactctccatctcactctaacatccttatcagctaaatatggtcctgttttatacctcaaattgggctctatgcctgtgattgttgtgtcctcaccatctgctgttgaagaatgtttaaccaagaatgatatcatattcgcaaataggcccaagaccgtggctggtgacaagtttacctacaattatactgtttatgtttgggcaccctatggccaactttggagaattcttcgccgattaactgtcgttgaactcttctcttcacatagcctacagaaaacttctatccttagagatcaagaagttgcaatatttatccgttcgttatacaaattctcaaaggatagtagcaaaaaagtcgatttgaccaactggtcttttactttggttttcaatcttatgaccaaaattattgctgggagacatattgtgaaggaggaagatgctggcaaggaaaagggcattgaaattattgaaaaacttagagggactttcttagtaactacatcattcttgaatatgtgtgatttcttgccagtattcaggtgggttggttacaaagggcaggagaagaagatggcctcaattcacaatagaagaaatgaattcttgaacagcttgcttgatgaatttcgacacaagaaaagtagtgcttcacaatctaacacaactgttggaaacatggagaagaaaaccacactgattgaaaagctcttgtctcttcaagaatcagagcctgaattctacactgatgatatcatcaaaagtattatgctggtagtttttgttgcaggaacagagacctcatcaacaaccatccaatgggtaatgaggcttcttgtagctcaccctgaggcattgtataagctacgagctgacattgacagtaaagttgggaataagcgcttgctgaatgaatcagacctcaacaagcttccgtatttgcattgtgttgttaatgagacaatgagattatacactccgataccacttttattgcctcattattcaactaaagattgtattgtggaaggatatgatgtaccaaaacatacaatgttgtttgtcaacgcttgggccattcacagggatcccaaggtatgggaggagcctgacaagttcaagccagagagatttgaggcaacagaaggggaaacagaaaggttcaattacaagcttgtaccatttggaatggggagaagagcgtgccctggagctgatatggggttgcgagcagtttctttggcattaggtgcacttattcaatgctttgactggcaaattgaggaagcggaaagcttggaggaaagctataattctagaatgactatgcagaacaagcctttgaaggttgtctgcactccacgcgaagatcttggccagcttctatcccaactctaaggcaatttatcaatgccaaacgtaatcttcatctaccactatg

SEQ ID NO: 285 - protein, 520 aa, Nicotiana tabacum
MENQYSYSFSSYFYLAIVLFLLPILVKYFFHRRRNLPPSPFSLPIIGHLYLLKKTLHLTLTSLSAKYGPVLYLKLGSMPVIVVSSPSAVEECLTKNDIIFANRPKTVAGDKFTYNYTVYVWAPYGQLWRILRRLTVVELFSSHSLQKTSILRDQEVAIFIRSLYKFSKDSSKKVDLTNWSFTLVFNLMTKIIAGRHIVKEEDAGKEKGIEIIEKLRGTFLVTTSFLNMCDFLPVFRWVGYKGQEKKMASIHNRRNEFLNSLLDEFRHKKSSASQSNTTVGNMEKKTTLIEKLLSLQESEPEFYTDDIIKSIMLVVFVAGTETSSTTIQWVMRLLVAHPEALYKLRADIDSKVGNKRLLNESDLNKLPYLHCVVNETMRLYTPIPLLLPHYSTKDCIVEGYDVPKHTMLFVNAWAIHRDPKVWEEPDKFKPERFEATEGETERFNYKLVPFGMGRRACPGADMGLRAVSLALGALIQCFDWQIEEAESLEESYNSRMTMQNKPLKVVCTPREDLGQLLSQL

SEQ ID NO: 286 - DNA, 1676 bp, Nicotiana tabacum
cctttttaagatgtatttaagatttaagatttaagatgaagcaactgaggtaagtcctttcaaggagtagttgtcacttctgagaatggagatgatgtacagcataatagcagcagccagtattgcaattatcttggtatatacatggaaagtgttgaattgggcttggtttgggccgaagaaaatggagaaatgcttaagacagaggggtctcaagggaaatccttataagctactctatggagatctaaacgaactgacaaaaagcataatagaagccaagtctaagcccatcaatttctctgatgatattgctcaaaggctcatccctttttttcttgacgccatcaacaaaaatggtaaaaactccttcgtctggcttggaccgtatccaatagtgttgatcacggatcctgagcatttaaaggagattttcacaaagaattatgtgtatcaaaagcaaactcatcccaatccatacgccaagctattagctcacggtcttgtcagccttgaggaagacaaatgggccaaacacagaaaaatcattagtcctgccttccatgtcgagaagctaaagcatatgctgcctgcattttatctgagttgtagtgaaatgataagcaaatgggaggaggttgttccaaaagaaacatcattcgagctcgatgtatggccagaccttcaaataatgaccagtgaagtcatttctcgcactgcatttgggagtagctatgaagaaggaagaatagtatttgaacttcagaaagaacaagctgagtatgtaatggacataggacgttcaatttatataccaggatcaaggttcttgcctactaaaaggaacaaaagaatgctggaaattgaaaagcaagtgcaaacaacaattaggcgtatcatcgacaaaagattgaaggcaatggaagaaggggagactagtaaagatgacttattaggcatattacttgaatccaatttgaaagaaattgaacttcatggaagaaatgacttgggaataacaacgtcagaagtgattgaagagtgcaagttattctattttgccggccaagagaccacttcagtgttgcttgtttggacaatgattttgttgtgcttacatccagagtggcaagtacgtgccagaaaggaagtgttgcagatctttggaaatgataaaccagatttggaaggactaagtcgcttgaaaattgtaacaatgatcttgtacgagacgttacgcctattccccccattaccagcatttggtagaaggaacaaagaagaagtcaaattaggggagctacatctaccggctggagtgttactcgttataccagcaatcttagtacattatgataaggaaatatggggtgaagatgcaaaggaattcaaaccagaaagattcagtgaaggagtgtcaaaggcaacaaatggacaagtctcatttataccatttagctggggacctcgtgtttgcattggacaaaacttcgcaatgatggaagcaaaaatggcagtaactatgatactacaaaaattctcctttgaactatccccttcttatacacatgctccatttgcaattgtgactattcatccccagtatggtgctcctctgcttatgcgcagactttaaaacatatgttgctgatatttaagatcagtggcgttttatt

SEQ ID NO: 287 - protein, 516 aa, Nicotiana tabacum
MEMMYSIIAAASIAIILVYTWKVLNWAWFGPKKMEKCLRQRGLKGNPYKLLYGDLNELTKSIIEAKSKPINFSDDIAQRLIPFFLDAINKNGKNSFVWLGPYPIVLITDPEHLKEIFTKNYVYQKQTHPNPYAKLLAHGLVSLEEDKWAKHRKIISPAFHVEKLKHMLPAFYLSCSEMISKWEEVVPKETSFELDVWPDLQIMTSEVISRTAFGSSYEEGRIVFELQKEQAEYVMDIGRSIYIPGSRFLPTKRNKRMLEIEKQVQTTIRRIIDKRLKAMEEGETSKDDLLGILLESNLKEIELHGRNDLGITTSEVIEECKLFYFAGQETTSVLLVWTMILLCLHPEWQVRARKEVLQIFGNDKPDLEGLSRLKIVTMILYETLRLFPPLPAFGRRNKEEVKLGELHLPAGVLLVIPAILVHYDKEIWGEDAKEFKPERFSEGVSKATNGQVSFIPFSWGPRVCIGQNFAMMEAKMAVTMILQKFSFELSPSYTHAPFAIVTIHPQYGAPLLMRRL

SEQ ID NO: 288 - DNA, 1577 bp, Nicotiana tabacum
ctaaatttcatatacctttagtactcttgaaattttcaaataatggtttatcttctttctcccatagaagccattgtaggatttgtaaccttttcatttctattctactttctatggaccaaaaaacaatcaaaaatcttaaacccactacctccaaaaatcccaggtggatggccagtaatcggccatctcttttatttcaagaacaatggcgatgaagatcgccatttttctcaaaaactcggtgacttagctgacaaatatggtcccgtcttcactttccggttagggtttcgccgtttcttggcggtgagtagttatgaagctatgaaagaatgcttcactaccaatgatatccatttcgccgatcggccatctttactctacggagaatacctttgctataataatgccatgcttgctgttgccaaatatggcccttactggaaaaaaaatcgaaagttagtcaatcaagaagttctctccgttagtcggctcgaaaaattcaaacatgttagattttctataattcagaaaaatattaaacaattgtataattgtgattcaccaatggtgaagataaaccttagtgattggatagataaattgacattcgacatcattttgaaaatggttgttgggaagaactataataatggacatggagaaatactcaaagttgcttttcagaaattcatggttcaagctatggagatggagctctatgatgtttttcacattccatttttcaagtggttggatcttacagggaatattaaggctatgaaacaaactttcaaagacattgataatattatccaaggttggttagatgagcacattaagaagagagaaacaaaggatgttggaggtgaaaacgaacaagattttatagatgtggtgctttccaagatgagcgacgaacatcttggcgagggttactctcatgacacaaccatcaaagcaactgtattcactttggtcttggatgcaacagacacacttgcacttcatataaagtgggtaatggcgttaatgataaacaataagcatgtcatgaagaaagcacaagaagagatggacacaattgttggtagagatagatgggtagaagagagtgatatcaagaatttggtgtatctccaagcaattgttaaagaagtattacgattacatccacctgcacctttgtcagtgcaacacctatctgtggaagattgtgttgtcaatgggtaccatattcctaaggggactgcactacttaccaatattatgaaactacagcgagatcctcaaacatggccaaatcctgataaattcgatccagagagattcctgacgactcatgctactattgactaccgcgggcagcactatgagttgatcccctttggtacggggagacgagcttgtcccgcgatgaattattcattgcaagtggaacacctttcaattgctcatatgatccaaggtttcagttttgcaactacgaccaatgagcctttggatatgaaacaaggtgtgggtttaactttaccaaagaagactgatgttgaagttctaattacccctcgttt

SEQ ID NO: 289 - protein, 511 aa, Nicotiana tabacum
MVYLLSPIEAIVGFVTFSFLFYFLWTKKQSKILNPLPPKIPGGWPVIGHLFYFKNNGDEDRHFSQKLGDLADKYGPVFTFRLGFRRFLAVSSYEAMKECFTTNDIHFADRPSLLYGEYLCYNNAMLAVAKYGPYWKKNRKLVNQEVLSVSRLEKFKHVRFSIIQKNIKQLYNCDSPMVKINLSDWIDKLTFDIILKMVVGKNYNNGHGEILKVAFQKFMVQAMEMELYDVFHIPFFKWLDLTGNIKAMKQTFKDIDNIIQGWLDEHIKKRETKDVGGENEQDFIDVVLSKMSDEHLGEGYSHDTTIKATVFTLVLDATDTLALHIKWVMALMINNKHVMKKAQEEMDTIVGRDRWVEESDIKNLVYLQAIVKEVLRLHPPAPLSVQHLSVEDCVVNGYHIPKGTALLTNIMKLQRDPQTWPNPDKFDPERFLTTHATIDYRGQHYELIPFGTGRRACPAMNYSLQVEHLSIAHMIQGFSFATTTNEPLDMKQGVGLTLPKKTDVEVLITPR

SEQ ID NO: 290 - DNA, 1434 bp, Nicotiana tabacum
  modified_base (564)..(564): a, c, g or t
ctttttctccccaaaaaagagctcatttcccttgtccccaaaaatggatcttctcttactagagaagaccttaattggtctcttctttgccattttaatcgctgtaattgtctctagacttcgttcaaagcgttttaagcttcccccaggaccaatcccagtaccagtttttggtaattggcttcaagttggtgatgatttaaaccacagaaatcttactgattttgccaaaaaatttggtgatcttttcttgttaagaatgggccagcgtaatttagttgttgtgtcatctcctgaattagctaaagaagttttacacacacaaggtgttgaatttggttcaagaacaagaaatgttgtatttgatatttttactggaaaaggtcaagatatggtttttactgtatatggtgaacactggagaaaaatgaggagaattatgactgtaccattttttactaataaagttgtgcagcaatatagaggggggtgggagtttgaagtggcaagtgtaattgaggatgtgaagaaaaatcctgaatctgctactaatgggattgtatnaaggaggagattacaattgatgatgtataataatatgtttaggattatgtttgataggagatttgagagtgaagatgatcctttgtttgttaagcttaaggctttgaatggtgaaaggagtagattggctcagagttttgagtataattatggtgattttattcccattttgaggccttttttgagaggttatttgaagatctgtaaagaagttaaggagaagaggctgcagcttttcaaagattactttgttgatgaaagaaagaagctttcaaataccaagagcttggacagcaatgctctgaaatgtgcgattgatcacattcttgaggctcaacagaagggggagatcaatgaggacaacgttctttacattgttgaaaacatcaatgttgctgctatagaaaccacattatggtcaattgagtggggtatcgccgagttagtcaaccaccctcacatccaaaagaaactccgcgacgagattgacacagttcttggcccaggagtgcaagtgactgaaccagacacccacaagcttccataccttcaggctgtgatcaaggagacgcttcgtctccgtatggcaattcctctattagtcccacacatgaaccttcacgatgcaaagcttggcgggtttgatattccagcagagagcaaaatcttggttaacgcttggtggctagctaacaacccggctcattggaagaaacccgaagagttcagacccgagaggttcttcgaagaggagaagcacgttgaggccaatggcaatgacttcagatatcttccgtttggcgttggtaggaggagttgccctggaactatacttgcattgccaattcttggcattactttgggacgttt

SEQ ID NO: 291 - protein, 463 aa, Nicotiana tabacum
MDLLLLEKTLIGLFFAILIAVIVSRLRSKRFKLPPGPIPVPVFGNWLQVGDDLNHRNLTDFAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPFLRGYLKICKEVKEKRLQLFKDYFVDERKKLSNTKSLDSNALKCAIDHILEAQQKGEINEDNVLYIVENINVAAIETTLWSIEWGIAELVNHPHIQKKLRDEIDTVLGPGVQVTEPDTHKLPYLQAVIKETLRLRMAIPLLVPHMNLHDAKLGGFDIPAESKILVNAWWLANNPAHWKKPEEFRPERFFEEEKHVEANGNDFRYLPFGVGRRSCPGTILALPILGITLGR

SEQ ID NO: 292 - DNA, 1723 bp, Nicotiana tabacum
ccaaattagagcaagaaattaacaagtctagttaccttctccctttttaagagtatttaagatttaagatttaagatgaagcaactgaggtaagtcctttcaaggagtagttgtcacttctgagaatggagatgatgtacagcataatagcagcagccagtattgcaattatcttggtatatacatggaaagtgttgaattgggcttggtttgggccaaagaaaatggagaaatgcttaagacagaggggtctcaagggaaatccttataagctactctatggagatctaaacgaactgacaaaaagcataatagaagccaagtctaagcccatcaatttctctgatgatattgctcaaaggctcatccctttttttcttgacgccatcaacaaaaatggtaaaaactccttcgtctggcttggaccgtatccaatagtgttgatcacggatcctgagcatttaaaggagattttcacaaagaattatgtgtatcaaaagcaaactcatcccaatccatacgccaagctattagctcacggtcttgtcagccttgaggaagacaaatgggccaaacacagaaaaatcattagtcctgccttccatgtcgagaagctaaagcatatgctgcctgcattttatctgagttgtagtgaaatgataagcaaatgggaggaggttgttccaaaagaaacatcattcgagctcgatgtatggccagaccttcaaataatgaccagtgaagtcatttctcgcactgcatttgggagtagctatgaagaaggaagaatagtatttgaacttcagaaagaacaagctgagtatgtaatggacataggacgttcaatttatataccaggatcaaggttcttgcctactaaaaggaacaaaagaatgctggaaattgaaaagcaagtgcaaacaacaattaggcgtatcatcgacaaaagattgaaggcaatggaagaaggggagactagtaaagatgacttattaggcatattacttgaatccaatttgaaagaaattgaacttcatggaagaaatgacttgggaataacaacatcagaagtgattgaagagtgcaagttaatctattttgccggccaagagaccacttcagtgttgcttgtttggacaatgattttgttgtgcttacatccagagtggcaagtacgtgccagaaaggaagtgttgcagacctttggaaatgataaaccagatttggaaggactaagtcgcttgaaaattgtaacaatgatcttgtacgagacgttacgcctattccccccattaccagcatttggtagaaggaacaaagaagaagtcaaattaggggagctacatctaccggctggagtgttactcgttataccagcaatcttagtacattatgataaggaaatatggggtgaagatgcaaaggaattcaaaccagaaagattcagtgaaggagtgtcaaaggcaacaaatggacaagtctcatttataccatttagctagggacctcgtgtttgcattggacaaaacttcgcaatgatggaagcaaaaatggcagtaactatgatactacaaaaattctcctttgaactatccccttcttatacacatgctccatttgcaattgtgactattcatccccagtatggtgctcctctgcttatgcgcagactttaaaacatatgttgctgatatttaagatcagtggcgttttattctccatg

SEQ ID NO: 293 - protein, 458 aa, Nicotiana tabacum
MEMMYSIIAAASIAIILVYTWKVLNWAWFGPKKMEKCLRQRGLKGNPYKLLYGDLNELTKSIIEAKSKPINFSDDIAQRLIPFFLDAINKNGKNSFVWLGPYPIVLITDPEHLKEIFTKNYVYQKQTHPNPYAKLLAHGLVSLEEDKWAKHRKIISPAFHVEKLKHMLPAFYLSCSEMISKWEEVVPKETSFELDVWPDLQIMTSEVISRTAFGSSYEEGRIVFELQKEQAEYVMDIGRSIYIPGSRFLPTKRNKRMLEIEKQVQTTIRRIIDKRLKAMEEGETSKDDLLGILLESNLKEIELHGRNDLGITTSEVIEECKLIYFAGQETTSVLLVWTMILLCLHPEWQVRARKEVLQTFGNDKPDLEGLSRLKIVTMILYETLRLFPPLPAFGRRNKEEVKLGELHLPAGVLLVIPAILVHYDKEIWGEDAKEFKPERFSEGVSKATNGQVSFIPFS

SEQ ID NO: 294 - DNA, 1717 bp, Nicotiana tabacum
tttgcctttgctcgtcattgatgacgacttcattttgttttcttccccacgaaaatggtagatatgatatggagggacgtagggaagaattactgggacaaacctagtgagtgaaaatggaaacagttgaaatgatagtaaaagtatcttgtgctgccatagtaattactctgttggtgtgtctatggagagtgctgaattgggtttggttcagaccaaagaaattagagaagttgttgagaaaacaggttttgtatggggacatgaaagagttttctgggatgattaaggaagcatactcaaagcctatgagtctgtctgatgatgtagcaccacgaatgatgcctttctttcttgaaaccatcaagaaatatggaaaaagatcctttatatggttcggtccaagaccactagtattgatcatggatcctgagcttataaaggaagtactctccaaaatctatctttatcaaaagcccggtggaaatccattagcaacactattggtacaaggattagcaacctatgaggaagacaaatgggccaaacatagaaaaatcatcaatcccgctttccatctagagaagctaaagcatatgcttccagcttttcgcttgagctgtagtgagatgctgagcaaatgggaagacattgtttcagctgaaggctcacatgagatagatgtatggcctaaccttgagcaattgagttgcgatgtgatctctcggacagcttttggcaatagttatgaagaaggtagaaagatttttgaacttcaaaaggaacaaactcagcatcttgtggaagctttccgctctgtttatatcccaggaaggagatttttgccaacaaagaggaatagaagaatgaaggaaataaaaaaggaggttcgagcgtcaattaaaggtattattgataaaagattgaaggcaatgaaagcaggggacaccaataatgaggatctattgggatattgctggaatcaaattttaaagaaattgaacagcgcggaaacaaggattttggaatgagcattgaagatgtcattgaagaatgcaagttattctattttgctggccaagaaactacatcagtgttgctcctatggtctctagtgtcgttgagcaggtatcaagattggcagacacgggccagagaagaagtcttgcatgtctttgggagtcggaaaccagattttgatgaattaaatcatctaaaagttgtgacaatgatcatgtacgagtctttaaggctatatccctcactaataacacttacccgccggtgtaatgaagacattgtattaggagaactatctctaccagctggtgtcctagtctctttgccaatgattttgttgcatcatgatgaagagatatggggtgaagatgcaaaggagttcaaaccagagagatttagagaaggattgtcaagtgcaacaaagggtcaacttacatattttccatttggctggggtcctagaatatgtattggacaaaattttgccatgttagaagcaaagatggctctgtctatgatcctgcaacgcttctcttttgaactgtctccgtcttatgcacatgcccctcagtccatattaaccgttcagcctcaatatggtgctccacttattttccacaagctataatttggtacttgtgaaaggtgtcttgtacaatatgttagtagagtttattcagacttagatacatgcttc

SEQ ID NO: 295 - protein, 304 aa, Nicotiana tabacum
METVEMIVKVSCAAIVITLLVCLWRVLNWVWFRPKKLEKLLRKQVLYGDMKEFSGMIKEAYSKPMSLSDDVAPRMMPFFLETIKKYGKRSFIWFGPRPLVLIMDPELIKEVLSKIYLYQKPGGNPLATLLVQGLATYEEDKWAKHRKIINPAFHLEKLKHMLPAFRLSCSEMLSKWEDIVSAEGSHEIDVWPNLEQLSCDVISRTAFGNSYEEGRKIFELQKEQTQHLVEAFRSVYIPGRRFLPTKRNRRMKEIKKEVRASIKGIIDKRLKAMKAGDTNNEDLLGYCWNQILKKLNSAETRILE

SEQ ID NO: 296 - DNA, 1559 bp, Nicotiana tabacum
ccaaaatgcagttcttcaacttcatttcctttgtcttttttgtgtctttcctctttttattaaggaaatggaagaactccaatagccaaaccaaaagattgcctccaggtccatggaaattacctgtacttggaagcatgtttcatttgctaggtggacctccacatcatgtccttggagatttagccaaaaaatatggtccacttatgcaccttcaactaggtgaagtttctgtagtttctgttacttctcctgagatggcaaaagaagtactaaaaactcatgacctcgcttttgcatctaggccgttacttttggcagccaaaattgtctgctataatgggacagacattgtcttttccccctatggcgattattggagacaaacgcgtaaaatttgtctcttggaattgctcagtgccaaaaatgttaggtcattcagctcagtcagacgagatgaagttttccatatgattgaatttttttcgatcatcttctggtaagccagttaatgtatcaaaaaggatttctctattcacaacctctatgacatgtagatcagcctttggacaagaatacaaggagcaagacgaattcgcacaactagtaaaaaaagtgtcaagcttaatggaagggtttgatgttgctgatatattcccttcattgaagtttcttcatgtgctcagtggaatgaaggctaaagttatggatgcacaccatgagttagatgccattcttgaaaaaattatcaatgagcacaagaaaattgcaactggaaagaataataatgaattaggaggtgaaggattaattgacgtactgctaagacttatgaaagagggaggccttcaattcccgatcaccaacgacaacatcaaagctattatttttgacatgtttggtgcgggaacggaaacttcatcaaccacaattgactgggccatggtcgaaatgataaagaatccaagtgtattcgctaaagctcaagcagaggtaagagaagccttcagagagaaagaaacttttgatgaaaatgatgtcgaggagttgaaatacttaaaattggttatcaaagaaactttcagactccatcctccatttccccttttgctcccaagagaatctagagaagaaacagatataaacggctacactattccttttaaaacaaaacttatggttaacgttcgggctattggaagagatccaaaatattgggatgacgtggaaagttttaagccagagagatttgagcacaactctatggattttattggtaataattttgaatatcttccctttggtagtggaaggagaatgtgccctgggatatcatttggtttggctaatgtttatttgccactagctcaattgttatatcattttgattggaaactccctactggaatcaattcaagtgacttggacatgactgagtcgtcaggagtaacttgtgctagaaagagtgatttatacttgactgctactccatatcaactttctcaagagtgatgcaatgatatcaaccttttgaatttcggtcaaccccaccaatagtg

SEQ ID NO: 297 - protein, 165 aa, Nicotiana tabacum
MQFFNFISFVFFVSFLFLLRKWKNSNSQTKRLPPGPWKLPVLGSMFHLLGGPPHHVLGDLAKKYGPLMHLQLGEVSVVSVTSPEMAKEVLKTHDLAFASRPLLLAAKIVCYNGTDIVFSPYGDYWRQTRKICLLELLSAKNVRSFSSVRRDEVFHMIEFFSIIFW

SEQ ID NO: 298 - DNA, 1601 bp, Nicotiana tabacum
ccccaccaaaaaatcatttctctcgtctaaaatggatcttctcttactagagaagaccttaattggtcttttctttgccattttaatcgctttaattgtctctaaacttcgttcaaagcgttttaagcttcctccaggaccaattccagtaccagtttttggtaattggcttcaagttggtgatgatttaaaccacagaaatcttactgattatgccaagaaatttggagatcttttcttgttaagaatgggtcaacgtaacttagttgttgtgtcatctcctgaattagctaaagaagttttacacacacaaggtgttgaatttggttcaagaacaagaaatgttgtgtttgatatttttactggaaaaggtcaagatatggtttttactgtatatggtgaacattggagaaaaatgaggagaattatgactgtaccattttttactaataaagttgtgcaacagtatagaggggggtgggagtttgaggtggcaagtgtaattgaggatgtgaaaaaaaatcctgaatctgctactaatgggatcgtattaaggaggagattacaattaatgatgtataataatatgtttaggattatgtttgataggagatttgagagtgaagatgatcctttgtttgttaagcttaaggctttgaatggtgaaaggagtagattggctcaaagttttgagtataattatggtgattttattccaattttgaggcctttttttgagaggttatttgaagatctgtaaagaagttaaggagaagaggctgcagcttttcaaagattactttgttgatgaaagaaagaagctttcgaataccaagagctcggacagcaatgccctaaaatgtgcgattgatcacattcttgaggctcaacagaagggagagatcaatgaggacaacgttctttacattgttgaaaacatcaatgttgctgcaattgaaacaacattatggtcaattgagtggggtatcgccgagctagtcaaccaccctcacatccaaaagaaactgcgcgacgagattgacacagttcttggaccaggagtgcaagtgactgaaccagacacccacaagcttccataccttcaggctgtgatcaaggaggcacttcgtctccgtatggcaattcctctattagtcccacacatgaaccttcacgacgcaaagcttggcgggtttgatattccagcagagagcaaaatcttggttaacgcttggtggttagctaacaacccggctcattggaagaaacccgaagagttcagacccgagaggttctttgaagaggagaagcatgttgaggccaatggcaatgacttcagatatcttccgtttggcgttggtaggaggagctgccctggaattatacttgcattgccaactcttggcatcactttgggacgtttggttcagaactttgagctgttgcctcctccaggccagtcgaagctcgacaccacagagaaaggtggacagttcagtctccacattttgaagcattccaccattgtgttgaaaccaaggtctttctgaactttgtgatcttattaattaaggggttctgaagaaatttgatagtgttgg

SEQ ID NO: 299 - protein, 242 aa, Nicotiana tabacum
MDLLLLEKTLIGLFFAILIALIVSKLRSKRFKLPPGPIPVPVFGNWLQVGDDLNHRNLTDYAKKFGDLFLLRMGQRNLVVVSSPELAKEVLHTQGVEFGSRTRNVVFDIFTGKGQDMVFTVYGEHWRKMRRIMTVPFFTNKVVQQYRGGWEFEVASVIEDVKKNPESATNGIVLRRRLQLMMYNNMFRIMFDRRFESEDDPLFVKLKALNGERSRLAQSFEYNYGDFIPILRPFFERLFEDL

SEQ ID NO: 300 - DNA, 1544 bp, Nicotiana tabacum; identical to SEQ ID NO: 266

SEQ ID NO: 301 - protein, 223 aa, Nicotiana tabacum; identical to SEQ ID NO: 267

SEQ ID NO: 302 - DNA, 1765 bp, Nicotiana tabacum
gtgaggtttgaatcctctgcctcaatgaaactcaccaaattggttttctaatttccatctaaaatattgtccaaagctaaagattctttctccttaaatagtcaactttagtggttcctcttcatttcatagctcaatctttcttattttgattcaaccatggagaaccaatactcctactcattctcttcctacttctacttagctatagtactgtttcttcttccaattttggtcaaatatttcttccatcggagaagaaatttacctccaagtccattttctcttccaataattggtcacctttaccttctcaagaaaactctccatctcactctaacatccttatcagctaaatatggtcctgttttatacctcaaattgggctctatgcctgtgattgttgtgtcctcaccatctgctgttgaagaatgtttaaccaagaatgatatcatattcgcaaataggcccaagaccgtggctggtgacaagtttacctacaattatactgtttatgtttgggcaccctatggccaactttggagaattcttcgccgattaactgtcgttgaactcttctcttcacatagcctacagaaaacttctatccttagagatcaagaagttgcaatatttatccgttcgttatacaaattctcaaaggatagtagcaaaaaagtcgatttgaccaactggtcttttactttggttttcaatcttatgaccaaaattattgctgggagacatattgtgaaggaggaagatgctggcaaggaaaagggcattgaaattattgaaaaacttagagggactttcttagtaactacatcattcttgaatatgtgtgatttcttgccagtattcaggtgggttggttacaaagggctggagaagaagatggcctcaattcacaatagaagaaatgaattcttgaacagcttgcttgatgaatttcgacacaagaaaagtagtgcttcacaatctaacacaactgttggaaacatggagaagaaaaccacactgattgaaaagctcttgtctcttcaagaatcagagcctgaattctacactgatgatatcatcaaaagtattatgctggtagtttttgttgcaggaacagagacctcatcaacaaccatccaatgggtaatgaggcttcttgtagctcaccctgaggcattgtataagctacgagctgacattgacagtaaagttgggaataagcgcttgctgaatgaatcagacctcaacaagcttccgtatttgcattgtgttgttaatgagacaatgagattatacactccgataccacttttattgcctcattattcaactaaagattgtattgtggaaggatatgatgtaccaaaacatacaatgttgtttgtcaacgcttgggccattcacagggatcccaaggtatgggaggagcctgacaagttcaagccagagagatttgaggcaacagaaggggaaacagaaaggttcaattacaagcttgtaccatttggaatggggagaagagcgtgccctggagctgatatggggttgcgagcagtttctttggcattaggtgcacttattcaatgctttgactggcaaattgaggaagcggaaagcttggaggaaagctataattctagaatgactatgcagaacaagcctttgaaggttgtctgcactccacgcgaagatcttggccagcttctatcccaactctaaggcaatttatcaatgccaaacgtaatcttcatctaccactatg

SEQ ID NO: 303 - protein, 520 aa, Nicotiana tabacum; identical to SEQ ID NO: 211

SEQ ID NO: 304 - DNA, 1694 bp, Nicotiana tabacum
aacatcctttccttcttccaaaaatggagcttcaatcttctcctttcaatttaatttctttgttcctcttcttttcttttctttttattctagtgaagaaatggaatgccaaaatcccaaagttacctccaggtccgtggaggcttccctttattggaagcctccatcacttgaagggaaaacttccacaccataatcttagagatctagcgcgaaaatatggacctctcatgtacttacaactcggagaaattcctgtagttgtaatatcttcgccacgtgtagcaaaagctgtactaaaaactcatgatctcgcttttgcaactagaccacgattcatgtcctcagacattgtgttttacaaaagcagggacatctcttttgccccatttggtgattactggagacagatgcgtaaaatattgactcaggaactcctgagcaacaagatgctcaagtcatatagcttaatccgaaaggatgagctctcgaagctcctctcatcgattcgtttggaaacaggttctgcagtgaacataaatgaaaagcttctctggtttacgagctgcatgacctgtagattagcctttggaaaaatatgcaatgatcgggatgagttgatcatgctaattagggagatattaacattatcaggaggatttgatgtgggtgatttgttcccttcctggaaattacttcataatatgagcaacatgaaagctaggttgacgaatgtacaccacaagtatgatttagttatggagaacatcatcaatgagcaccaagagaatcatgcagcagggataaagggtaacaacgagtttggtggcgaagatatgatcgatgctctactgagggctaaggagaataatgagcttcaatttcctatcgaaaatgacaacatgaaagcagtaattctggacttgtttattgctggaactgaaacttcatatactgcaattatatgggcactatcagaattgatgaagcacccaagtgtgatggccaaggcacaagctgaagtgagaaaagtcttcaaagaaaatgaaaatttcgacgaaaatgatcttgacaagttgccatacctaaaatcagtgattaaagaaacactaaggatgcaccctccagttcctttgttagggcctagagaatgcagggaccaaacagagatcgatggctacactgtacctattaaagctagagttatggttaatgcttgggcgataggaagagatcctgaaagttgggaagatcctgaaagtttcaaaccggagcgatttgaaaatacttctgttgatcttacaggaaatcactatcagttcattcctttcggttcaggaagaagaatgtgtccaggaatgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatagcttaatttaatggagttcttggaagaattaaagaagaagggctatataggtgagattttttgtatggttgcaaggtttttagttcatacaataagacaatacattatattccagtattgtgtatcatgtataataaggttccttttgtttaaaaaa

SEQ ID NO: 305 - protein, 504 aa, Nicotiana tabacum; identical to SEQ ID NO: 169

SEQ ID NO: 306 - DNA, 1819 bp, Nicotiana tabacum
caatcagtggatgcgggagtaatatataatatgcaagttgtagaaagagaaaaaaaaaatcaagtagctattctatactggggcacaaatagtgagtgaaaatggagactgttcaaatcataataacagcatcttgtgctgccataataattactctagtggtgtgtatttggagagtactgaattgggtttggttcagaccaaagaagctggaaaaactattgaggaaacaaggtctcaaaggcaactcctacaagattttgtatggggatatgaaggagctttctggtatgattaaggaagctaattccaaacccatgaatctttctgatgatattgcaccaagattggtgcctttctttcttgacaccatcaagaaatatggtaaaaaatcctttgtatggttaggtccgaaaccactggttcttatcatggaccctgagcttataaaggaaatattttccaaatactatctgtatcaaaagcctcatggaaatccagttaccaagctattagtacaaggactagtaagcctagaggaagacaaatgggccaaacatagaaaaatcatcaatccagctttccatctagagaagctaaagcatatgcttccagctttttgcttgagctgcactgagatgctgtgcaaatgggaagatattgtttcaattaagggctcacatgagatagatgtatggcctcaccttgaacaattaagtagcgatgtgatctctcggacagcttttggcagtaactttgaagaaggtaaaaggatatttgaacttcagaaggaacaagctcagtattttgtagaagctatacgctcggtttatataccaggctggaggtttttgccaacaaagaggaacagaagaatgaaggaagttgaaaaggatgttcgggcctcgataagaggcattattgataaaagagtgaaggcaatgaaagcaggagaggcgagtaatgaggatctacttggtatattgttggaatctaattttacagaagctgaacagcatagacacaaggattctgcgatgagcattgaagaagtcattcaagaatgcaagttattctatgttgctggccaagaaactacatcagtgttgcttgtgtggactctaatattgttgagtaggcatcaagattggcagagccgagccagagaagaggtgtttcaagtctttggtaatcagaaaccagattttgacggattgaatcgtctaaaagttgtgacaatgatcttgtatgagtctttaaggctatactccccagtagtgtcactaatccggcggcctaatgaggatgctatattaggaaatgtatctctgccagaaggtgtgctactctcattaccagtgatcttattacaccacgatgaagagatatggggtaaagatgcaaagaagttcaatccagaaagatttagagatggagtctcaagtgcaacaaagggtcaagtcactttttttccatttacttggggtcccagaatatgcatcggacaaaattttgccatgttagaagcaaagactgctttggctatgatcctacaacgcttctcattcgaactgtctccatcttatgcacatgctcctcagtccatattaactatgcaaccccaacatggtgctccactaattctgcacaaaatatagtttgttactttaagcagtgtcttgttatatgtcagagagtccaaaatgtttaattaaggcttgtagaactgccaaatggaacttcatttgcattcgtgggttgtagattgttgtaattggacaagtatactgtttattttagagttttaagaaaaaaaaaa

SEQ ID NO: 307 - protein, 518 aa, Nicotiana tabacum
METVQIIITASCAAIIITLVVCIWRVLNWVWFRPKKLEKLLRKQGLKGNSYKILYGDMKELSGMIKEANSKPMNLSDDIAPRLVPFFLDTIKKYGKKSFVWLGPKPLVLIMDPELIKEIFSKYYLYQKPHGNPVTKLLVQGLVSLEEDKWAKHRKIINPAFHLEKLKHMLPAFCLSCTEMLCKWEDIVSIKGSHEIDVWPHLEQLSSDVISRTAFGSNFEEGKRIFELQKEQAQYFVEAIRSVYIPGWRFLPTKRNRRMKEVEKDVRASIRGIIDKRVKAMKAGEASNEDLLGILLESNFTEAEQHRHKDSAMSIEEVIQECKLFYVAGQETTSVLLVWTLILLSRHQDWQSRAREEVFQVFGNQKPDFDGLNRLKVVTMILYESLRLYSPVVSLIRRPNEDAILGNVSLPEGVLLSLPVILLHHDEEIWGKDAKKFNPERFRDGVSSATKGQVTFFPFTWGPRICIGQNFAMLEAKTALAMILQRFSFELSPSYAHAPQSILTMQPQHGAPLILHKI

SEQ ID NO: 308-366 - skipped (59 entries)

SEQ ID NO: 367 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctgaaaaaaattatgaatccggtaaaggagatgaacaattggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 368 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAEKNYESGKGDEQLERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 369 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcaattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggatcttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttaggggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 370 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGNYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDLMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVRGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 371 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcgtgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 372 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVVKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 373 - DNA, 1577 bp, Nicotiana tabacum
cataatgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggattcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgatgaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattggctttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 374 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDSFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLMNNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIGFRGQYYKYIPFGSGRRSCPGMTYALQVEHLTMAHLIQGFNYRTPNDEPLDMKEGAGITIRKVNPVELIIAPRLAPELY

SEQ ID NO: 375 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttctcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggactttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 376 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRAFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFVNVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 377 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgatgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggcctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaagggcttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgtaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 378 - protein, 517 aa, Nicotiana tabacum; identical to SEQ ID NO: 376

SEQ ID NO: 379 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctggtcgtgaagatgatcgctggaaaaaattatgaatccggtaaaggagatgaacaagtggagagatttaagaaagcgtttgaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 380 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLVVKMIAGKNYESGKGDEQVERFKKAFEDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 381 - DNA, 1573 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcaaaaactcggagacttagctgacaaatacggccccgttttcacttttcggctaggccttccccttgtcttagttgtaagcagttacgaagctgtaaaagactgtttctctacagatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttggtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatagcacatttgatccaaggtttcaattacagaactccaaatgacgagcccttggatatgaaggaaggtgcaggcataactatacgtaaggtaaatcctgtggaactgataatagcgcctcgcctggcacctgagctttattaaaacctaagatcatcttgct

SEQ ID NO: 382 - protein, 517 aa, Nicotiana tabacum
MLSPIEAIVGLVTFTFLFFFLWTKKSQKPSKPLPPKIPGGWPVIGHLFHFNDDGDDRPLAQKLGDLADKYGPVFTFRLGLPLVLVVSSYEAVKDCFSTDDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFGLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTIAHLIQGFNYRTPNDEPLDMKEGAGITIRKVNPVELIIAPRLAPELY

SEQ ID NO: 383 - DNA, 1575 bp, Nicotiana tabacum
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagccctcggatatgaaggaaggtgcaggcataactatacgtaaagtaaatcctgtggaactgataatagcgcctcgcctggcacctgagctttattaaaacctaagatcatcttgcttg

SEQ ID NO: 384 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPSDMKEGAGITIRKVNPVELIIAPRLAPELY

SEQ ID NO: 385 - DNA, 25 bp, Artificial Sequence
  Description of Artificial Sequence: Synthetic probe
gaaagcgtttaaggattttatgatt

SEQ ID NO: 386 - DNA, 25 bp, Artificial Sequence
  Description of Artificial Sequence: Synthetic probe
gattttatcaatggagtttgtgtta

SEQ ID NO: 387 - DNA, 25 bp, Artificial Sequence
  Description of Artificial Sequence: Synthetic probe
ttatgggatgcatttccaattccat

SEQ ID NO: 388 - DNA, 25 bp, Artificial Sequence
  Description of Artificial Sequence: Synthetic probe
tgggatgcatttccaattccattat

SEQ ID NO: 389 - DNA, 25 bp, Artificial Sequence
  Description of Artificial Sequence: Synthetic probe
ggatgcatttccaattccattattt

SEQ ID NO: 390 - DNA, 25 bp, Artificial Sequence
  Description of Artificial Sequence: Synthetic probe
gatgcatttccaattccattattta

SEQ ID NO: 391 - DNA, 25 bp, Artificial Sequence
  Description of Artificial Sequence: Synthetic probe
tgcatttccaattccattatttaaa

SEQ ID NO: 392 - DNA, 25 bp, Artificial Sequence
  Description of Artificial Sequence: Synthetic probe
gcatttccaattccattatttaaat

SEQ ID NO: 393 - DNA, 25 bp, Artificial Sequence
  Description of Artificial Sequence: Synthetic probe
tatttaaatgggtggattttcaagg

SEQ ID NO: 394 - DNA, 25 bp, Artificial Sequence
  Description of Artificial Sequence: Synthetic probe
attttcaagggcatgttaaggctat

SEQ ID NO: 395 - DNA, 25 bp, Artificial Sequence
  Description of Artificial Sequence: Synthetic probe
caagggcatgttaaggctatgaaaa

SEQ ID NO: 396 - DNA, 25 bp, Artificial Sequence
  Description of Artificial Sequence: Synthetic probe
ggcatgttaaggctatgaaaaggac

SEQ ID NO: 397 - DNA, 25 bp, Artificial Sequence
  Description of Artificial Sequence: Synthetic probe
tgttaaggctatgaaaaggactttt

SEQ ID NO: 398 - DNA, 25 bp, Artificial Sequence
  Description of Artificial Sequence: Synthetic probe
aaggttactctcgtgatactgtcat

SEQ ID NO: 399 - DNA, 25 bp, Artificial Sequence
  Description of Artificial Sequence: Synthetic probe
gcagacacagttgctcttcacataa

SEQ ID NO: 400 - DNA, 25 bp, Artificial Sequence
  Description of Artificial Sequence: Synthetic probe
acagttgctcttcacataaattggg

SEQ ID NO: 401 - DNA, 25 bp, Artificial Sequence
  Description of Artificial Sequence: Synthetic probe
ggtatacctccaagctattgttaaa

SEQ ID NO: 402 - DNA, 25 bp, Artificial Sequence
  Description of Artificial Sequence: Synthetic probe
gtgttacgattatatccaccaggac

SEQ ID NO: 403 - DNA, 25 bp, Artificial Sequence
  Description of Artificial Sequence: Synthetic probe
tacgattatatccaccaggaccttt

SEQ ID NO: 404 - DNA, 25 bp, Artificial Sequence
  Description of Artificial Sequence: Synthetic probe
ccaggacctttgttagtaccacacg

SEQ ID NO: 405 - DNA, 25 bp, Artificial Sequence
  Description of Artificial Sequence: Synthetic probe
cctttgttagtaccacacgaaaatg

SEQ ID NO: 406 - DNA, 25 bp, Artificial Sequence
  Description of Artificial Sequence: Synthetic probe
tacgtgatcctaaactctggcctga

SEQ ID NO: 407 - DNA, 25 bp, Artificial Sequence
  Description of Artificial Sequence: Synthetic probe
ctgatcctgatactttcgatccaga

SEQ ID NO: 408 - DNA, 25 bp, Artificial Sequence
  Description of Artificial Sequence: Synthetic probe
gactttcgtggtcagtactataagt

SEQ ID NO: 409 - DNA, 25 bp, Artificial Sequence
  Description of Artificial Sequence: Synthetic probe
tggtcagtactataagtatatcccg

SEQ ID NO: 410 - DNA, 25 bp, Artificial Sequence
  Description of Artificial Sequence: Synthetic probe
gaattgaattttggtctgatcgtga

SEQ ID NO: 411 - DNA, 25 bp, Artificial Sequence
  Description of Artificial Sequence: Synthetic probe
tggtctgatcgtgaagatgatcgct

SEQ ID NO: 412 - DNA, 25 bp, Artificial Sequence
  Description of Artificial Sequence: Synthetic probe
atcgtgaagatgatcgctggaaaaa

SEQ ID NO: 413 - DNA, 25 bp, Artificial Sequence
  Description of Artificial Sequence: Synthetic probe
gatgatcgctggaaaaaattatgaa

SEQ ID NO: 414 - DNA, 25 bp, Artificial Sequence
  Description of Artificial Sequence: Synthetic probe
tatgaatccggtaaaggagatgaac

SEQ ID NO: 415 - DNA, 25 bp, Artificial Sequence
  Description of Artificial Sequence: Synthetic probe
tccggtaaaggagatgaacaagtgg

SEQ ID NO: 416 - DNA, 25 bp, Artificial Sequence
  Description of Artificial Sequence: Synthetic probe
aacaagtggagagatttaagaaagc

SEQ ID NO: 417 - DNA, 25 bp, Artificial Sequence
  Description of Artificial Sequence: Synthetic probe
gattttatcaatggagtttgtgtta

SEQ ID NO: 418 - DNA, 25 bp, Artificial Sequence
  Description of Artificial Sequence: Synthetic probe
ttatgggatgcatttccaattccat

SEQ ID NO: 419 - DNA, 25 bp, Artificial Sequence
  Description of Artificial Sequence: Synthetic probe
tgggatgcatttccaattccattat

SEQ ID NO: 420 - DNA, 25 bp, Artificial Sequence
  Description of Artificial Sequence: Synthetic probe
ggatgcatttccaattccattattt

SEQ ID NO: 421 - DNA, 25 bp, Artificial Sequence
  Description of Artificial Sequence: Synthetic probe
gatgcatttccaattccattattta

SEQ ID NO: 422 - DNA, 25 bp, Artificial Sequence
  Description of Artificial Sequence: Synthetic probe
tgcatttccaattccattatttaaa

SEQ ID NO: 423 - DNA, 25 bp, Artificial Sequence
  Description of Artificial Sequence: Synthetic probe
cattatttaaatgggtggattttca

SEQ ID NO: 424 - DNA, 25 bp, Artificial Sequence
  Description of Artificial Sequence: Synthetic probe
attttcaagggcatgttaaggctat

SEQ ID NO: 425 - DNA, 25 bp, Artificial Sequence
  Description of Artificial Sequence: Synthetic probe
caagggcatgttaaggctatgaaaa

SEQ ID NO: 426 - DNA, 25 bp, Artificial Sequence
  Description of Artificial Sequence: Synthetic probe
tgttaaggctatgaaaaggactttt

SEQ ID NO: 427 - DNA, 25 bp, Artificial Sequence
  Description of Artificial Sequence: Synthetic probe
aaggttactctcgtgatactgtcat

SEQ ID NO: 428 - DNA, 25 bp, Artificial Sequence
  Description of Artificial Sequence: Synthetic probe
gcagacacagttgctcttcacataa

SEQ ID NO: 429 - DNA, 25 bp, Artificial Sequence
  Description of Artificial Sequence: Synthetic probe
gttacgattatatccaccaggacct

SEQ ID NO: 430 - DNA, 25 bp, Artificial Sequence
  Description of Artificial Sequence: Synthetic probe
ccaggacctttgttagtaccacacg

SEQ ID NO: 431 - DNA, 25 bp, Artificial Sequence
  Description of Artificial Sequence: Synthetic probe
cctttgttagtaccacacgaaaatg

SEQ ID NO: 432 - DNA, 25 bp, Artificial Sequence
  Description of Artificial Sequence: Synthetic probe
aactctggtctgatcctgatacttt

SEQ ID NO: 433 - DNA, 25 bp, Artificial Sequence
  Description of Artificial Sequence: Synthetic probe
gactttcgtggtcagtactataagt

SEQ ID NO: 434 - DNA, 25 bp, Artificial Sequence
  Description of Artificial Sequence: Synthetic probe
tggtcagtactataagtatatcccg

SEQ ID NO: 435 - DNA, 25 bp, Artificial Sequence
  Description of Artificial Sequence: Synthetic probe
gatccaaggtttcaattacagaact

SEQ ID NO: 436 - DNA, 25 bp, Artificial Sequence
  Description of Artificial Sequence: Synthetic probe
gtgcaggcataactatacgtaaggt

SEQ ID NO: 437 - DNA, 25 bp, Artificial Sequence
  Description of Artificial Sequence: Synthetic probe
aatcctgtggaactgataatagcgc

SEQ ID NO: 438 - DNA, 25 bp, Artificial Sequence
  Description of Artificial Sequence: Synthetic probe
atcctgtggaactgataatagcgcc

SEQ ID NO: 439 - DNA, 25 bp, Artificial Sequence
  Description of Artificial Sequence: Synthetic probe
cctgtggaactgataatagcgcctc

SEQ ID NO: 440 - DNA, 25 bp, Artificial Sequence
  Description of Artificial Sequence: Synthetic probe
tgtggaactgataatagcgcctcgc

SEQ ID NO: 441 - DNA, 25 bp, Artificial Sequence
  Description of Artificial Sequence: Synthetic probe
ggaactgataatagcgcctcgcctg

SEQ ID NO: 442 - DNA, 25 bp, Artificial Sequence
  Description of Artificial Sequence: Synthetic probe
gaactgataatagcgcctcgcctgg

SEQ ID NO: 443 - DNA, 25 bp, Artificial Sequence
  Description of Artificial Sequence: Synthetic probe
actgataatagcgcctcgcctggca

SEQ ID NO: 444 - DNA, 25 bp, Artificial Sequence
  Description of Artificial Sequence: Synthetic probe
tcgcctggcacctgagctttattaa

SEQ ID NO: 445 - DNA, 25 bp, Artificial Sequence
  Description of Artificial Sequence: Synthetic probe
ctggcacctgagctttattaaaacc

SEQ ID NO: 446 - DNA, 393 bp, Nicotiana tabacum
gtttttcccatagaagcctttgtaggactagtaaccttcacatttctctcatacttcctatggacaaaaaaatctcaaaaacttccaaaacccttaccaccgaaaatccccggaggatggccggtaatcggccatctttttcacttcaataacgacggcgacgaccgtccattagctcgaaaactcggagacttagctgataaatacggccccgttttcacttttcggctaggtcttccccttgtgctagttgtaagcagttacgaagctataaaagattgcttctctacaaatgacgccattttctccaatcgtccagcttttctttacggcgaataccttggctacaataatacaatgctttttctagcaaattacggaccttactggcga

SEQ ID NO: 447 - DNA, 479 bp, Nicotiana tabacum
tagtatacctccaagctattgttaaaaaggtgttacgattatatccaccaggacctttgttagtaccacatgaaaatgtaaaggattgtgttgttagtggatatcacattcctaaagggactagattattcgcaaacgtcatgaaactgcagcgcgatcctaaattcttgtcaaatcctgataagttcgatccagagagattcatcgctggtgatattgacttccgtggtcaccactatgagtttatcccatttggttctggaagacgatcttgtccggggatgacttatgcatcgcaagtggaacacctaacaatggcacatttagtccagggtttcaattacaaaactccaaatgacgaggccttggatatgaaggaaggtgcaggcataacaatacgtaaggtaaatccagtggaattgatagtaacgcctcgcttggcacctgagctttactaaacctaagatctttcatcttgg

SEQ ID NO: 448 - protein, 151 aa, Nicotiana tabacum
VYLQAIVKKVLRLYPPGPLLVPHENVKDCVVSGYHIPKGTRLFANVMKLQRDPKFLSNPDKFDPERFIAGDIDFRGHHYEFIPFGSGRRSCPGMTYASQVEHLTMAHLVQGFNYKTPNDEALDMKEGAGITIRKVNPVELIVTPRLAPELY

SEQ ID NO: 449 - DNA, 512 bp, Nicotiana tabacum
ggatagatgggtagaagagagtgatattaaggatttggtgtacctccaagctattgtcaaagaagtgttacgattgtatccaccaggacctttgttagtaccacatgaaaatgtggaggattgtgttgttagtggatatcacattcctaaagggactagactatttgcgaatgtcatgaaactgtaacgcgatcctaaactctggccaaatcctgataatttcgatccagagagattcatcgctgcagatattgacttccgtggtcagcactatgagtatatcccgtttggttctggaagacgatcttgtccggggatgacttatgcattgcaagcggaacatctaacaatggcacatttgatccaaggtttcaattacaggactccaactaacgagcccttggatatgaaggaaggtgcaggcataactatacgtaaggtaaatcctgtggaagtgctaattaagcctcgcctggcacccgagctttattaaaacctaagatcatcttgct

SEQ ID NO: 450 - protein, 61 aa, Nicotiana tabacum
DRWVEESDIKDLVYLQAIVKEVLRLYPPGPLLVPHENVEDCVVSGYHIPKGTRLFANVMKL

SEQ ID NO: 451 - DNA, 503 bp, Nicotiana tabacum
aggatagatgggtagaagagagtgatattaaggatttggtgtacctccaagctattgtcaaagaagtgttacgattgtatccaccaggacctttgttagtaccacatgaaaatgtagaggattgtgttgttagtggatatcacattcctaaagggactagactatttgcgaatgtcatgaaactgcaacgcgatcctaaactctggccaaatcctgataatttcgatccagagagattcgtcgctgcagatattgacttccgtggtcagcactatgagtatatcccgtttggttctggaagacgatcttgtccgggggtgacttatgcattgcaagtggaacatcacatttgatccaaggtttcaattacaggactccaactaacgagcccttggatatgaaggaaggtgcacgcataactatacgtaaggtaaatcctgtggaagtgctaattaagcctagcctggcacctgagctttattaaaacctaagatcatcttgct

SEQ ID NO: 452 - protein, 68 aa, Nicotiana tabacum
VYPVWFWKTILSGGDLCIASGTSHLIQGFNYRTPTNEPLDMKEGARITIRKVNPVEVLIKPSLAPELY

SEQ ID NO: 453 - DNA, 410 bp, Nicotiana tabacum
ctgaaatagagggagtataatattcatttcaagagatcactataaaaaggaagttcgtgatagtttgattctcaagttcttatctaaaaatccataatggtttttcccatagaagccattgtaggactagtaaccttcacatttctcttatacttcctatggacaaaaaaatctcaaaaacctccaaaacccttaccaccgaaaatccccggaggatggccggtaatcggccatcttttctacttcgataacgaaggcgacgaccgtccattagctcggagacttagctgataaatacggccccgttttcacttttcggctaggtcttccccttgtgctagttgtaagcagttatgaagctataaaagattgcttctctacaaatgacgccattttctccaatcgtccag

SEQ ID NO: 454 - protein, 60 aa, Nicotiana tabacum
MVFPIEAIVGLVTFTFLLYFLWTKKSQKPPKPLPPKIPGGWPVIGHLFYFDNEGDDRPLA

SEQ ID NO: 455 - DNA, 421 bp, Nicotiana tabacum
ggacctttgttagtaccacatgaaaatgtaaaggattgtgttgttagtggatatcacattcctaaagggactagattattcgcaaacgtcatgaaactgcagcgcgatcctaaattcttgtcaaatcctgataagttcgatccagagagattcatcgctggtgatattgacttccgtggtcaccactatgagtttatcccatttggtcctggaagacgatcttgtccggggatgacttatgcattgcaagtggaacacctaacaatggcacatttaatccagggtttcaattacaaaactccaaatgacgagcccttggatatgaaggaaggtgcaggcataactatacgtaaggtaaatcctgtggaactgataatagcgcctcgcctggcacctgagctttattaaaacctaagatcat

SEQ ID NO: 456 - protein, 135 aa, Nicotiana tabacum
GPLLVPHENVKDCVVSGYHIPKGTRLFANVMKLQRDPKFLSNPDKFDPERFIAGDIDFRGHHYEFIPFGPGRRSCPGMTYALQVEHLTMAHLIQGFNYKTPNDEPLDMKEGAGITIRKVNPVELIIAPRLAPELY

SEQ ID NO: 457 - DNA, 577 bp, Nicotiana tabacum
atgacattattgataaacaatcaaaatgccttgatgaaagcacaagaagagatagacacaaaagttggtaaggatagatgggtagaagagagtgatattaaggatttagtatacctccaagctattgttaaaaaggtgttacgattatatccaccaggacctttgttagtaccacatgaaaatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaagactccaaatggcgaggccttggatatgaaggaaggtgcaggcataacaatacgtaaggtaaatccagtggaattgataatagcgcctcgcctggcacctgagctttattaatacctaagatcat

SEQ ID NO: 458 - protein, 187 aa, Nicotiana tabacum
MTLLINNQNALMKAQEEIDTKVGKDRWVEESDIKDLVYLQAIVKKVLRLYPPGPLLVPHENVKDCVVSGYHIPKGTRLFANVMKLQRDPKLLSNPDKFDPERFIAGDIDFRGHHYEFIPFGSGRRSCPGMTYALQVEHLTMAHLIQGFNYKTPNGEALDMKEGAGITIRKVNPVELIIAPRLAPELY

SEQ ID NO: 459 - DNA, 381 bp, Nicotiana tabacum
ggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttattaaaacctaagatcatcttgcttg

SEQ ID NO: 460 - protein, 119 aa, Nicotiana tabacum
GYHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 461 - DNA, 444 bp, Nicotiana tabacum
cgattatatccaccgggacctttattagtaccccatgaaaatgtagaggattgtgttgttagtggatatcacattcctaaagggactagactattcgcgaacgttatgaaattacagcgcgatcctaaactctggtcaaatcctgataagttcgatccagagagatttttcgctgctgatattgactttcgtggtcaacactatgagtttatcccatttggttctggaagacgatcttgtccggggatgacttatgctatgcaagtggaacacctaacaatcgcacacttgatccagggtttcaattacaaaactccaaatgacgagcccttggatatgaaggaaggtgcaggattaactatacgtaaggtaaatcctatagaagtggtaattacgcctcgcctgacacctgagctttattaaaacctaagatcatcttgcttg

SEQ ID NO: 462 - protein, 140 aa, Nicotiana tabacum
RLYPPGPLLVPHENVEDCVVSGYHIPKGTRLFANVMKLQRDPKLWSNPDKFDPERFFAADIDFRGQHYEFIPFGSGRRSCPGMTYAMQVEHLTIAHLIQGFNYKTPNDEPLDMKEGAGLTIRKVNPIEVVITPRLTPELY

SEQ ID NO: 463 - DNA, 379 bp, Nicotiana tabacum
atatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttattaaaacctaagatcatcttgcttg

SEQ ID NO: 464 - protein, 118 aa, Nicotiana tabacum
YHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 465 - DNA, 440 bp, Nicotiana tabacum
gtgatactgtcataaaagcaacagtgtttagtttagtcttggatgctgcggacacagttgctcttcacatgaattggggaatggcattattgataaacaatcaacatgccttgaagaaagcgcaagaagagatagataaaaaagttggtaaggatagatgggtagaagagagtgatattaaggatttggtatacctccaaactattgttaaagaagtgttacgattatatccaccgggacctttattagtaccccatgaaaatgtagaggattgtgttgttagtggatatcacattcctaaagggactagactattcgcgaacgttatgaaattacagcgcgatcctaaactctggtcaaatcctgataagttcgatccagagagatttttcgctgctgatattgactttcgtggtcaacactatgagtttatcccattt

SEQ ID NO: 466 - protein, 146 aa, Nicotiana tabacum
DTVIKATVFSLVLDAADTVALHMNWGMALLINNQHALKKAQEEIDKKVGKDRWVEESDIKDLVYLQTIVKEVLRLYPPGPLLVPHENVEDCVVSGYHIPKGTRLFANVMKLQRDPKLWSNPDKFDPERFFAADIDFRGQHYEFIPF

SEQ ID NO: 467 - DNA, 386 bp, Nicotiana tabacum
ataatgctttctcccatagaagccattgtaggagcagtaaccctaattacatttctcttatacttcctatgtacaaaagaatctcaaaaacattcaaagcccttaccaacgaaaatccccggaggatggccggtaatcggccatcttttccacttcaataacgacggcgacgaccgtccattagctcgaaaactcggagacttagctgataaatacggccccgttttcacttttcggctaggtcttccccttgtgctagttgtaagcagttacgaagctttaaaagattgcttctctacaaatgacgccattttctccaatcgtccagcttttctttacggcgaataccttggctacaataatacaatgctttttctagcaaatta

SEQ ID NO: 468 - protein, 127 aa, Nicotiana tabacum
MLSPIEAIVGAVTLITFLLYFLCTKESQKHSKPLPTKIPGGWPVIGHLFHFNNDGDDRPLARKLGDLADKYGPVFTFRLGLPLVLVVSSYEALKDCFSTNDAIFSNRPAFLYGEYLGYNNTMLFLAN

SEQ ID NO: 469 - DNA, 552 bp, Nicotiana tabacum
agaaagcacaagaagagatagacacaaaagttggcaaggatagatgggtagaagagagtgatattaaggatttggtgtacctccaagctattgttaaagaagtgttacgattatatccaccgggacctttgttagtaccacatgaaaatatagaggattgtgttgttagtggatattacatttctaaagggactagactattcgcaaatgttatgaaactgcagcgcgatcctaaactctggccaaatcctgataatttcgatccagagagatttgtcgctgcaggtattgactttcgtggtcagcattatgagtatatcccgtttggttctggaagacgatcttgtccggggatgacttatgcattgcaagtggaacacttaacaatggcacatttgatccagggtttcaattacagcactccaaatgacgagcccttggatatgaaggaaggtgcaggtataactatacgtaaggtaaatcccgtggaagtgataattatgcctcgcctggcacctgagctttattaaaacctaagatctttcatcttgg

SEQ ID NO: 470 - protein, 175 aa, Nicotiana tabacum
KAQEEIDTKVGKDRWVEESDIKDLVYLQAIVKEVLRLYPPGPLLVPHENIEDCVVSGYYISKGTRLFANVMKLQRDPKLWPNPDNFDPERFVAAGIDFRGQHYEYIPFGSGRRSCPGMTYALQVEHLTMAHLIQGFNYSTPNDEPLDMKEGAGITIRKVNPVEVIIMPRLAPELY

SEQ ID NO: 471 - DNA, 609 bp, Nicotiana tabacum
ataatgctttctcccatagaagccattgtaggactagtaaccttcacatttctcttctacttcctatggacaaaaaaatctcaaaaaccttcaaaacccttaccaccgaaaatccccggaggatggccggtaattggccatcttttccacttcaatgacgacggcaacgaccgtccattagctcgaaaactcggagacttagctgacaaatacggccccgttttcacttttcggctaggccttccccttgtgttagttgtaagcagttacgaagctataaaagactgtttctctacaaatgatgccattttctctaatcgtccagcttttctttacggcgaataccttggctacaataatgccatgctatttttggcaaattacggaccttactggcgaaaaaatcgtaaattagttattcaggaagttctctcagctagtcgtctcaaaaaattcaaacacgtgagattcgccagaattcaaacgagcattaagaatttatacactcgaattgatagaaattcgagtacgataaatttaactgattggttagaagaattgaattttggtctcatcgtgaagatgatagctgggaaaaattatgattcc

SEQ ID NO: 472 - protein, 202 aa, Nicotiana tabacum
MLSPIEAIVGLVTFTFLFYFLWTKKSQKPSKPLPPKIPGGWPVIGHLFHFNDDGNDRPLARKLGDLADKYGPVFTFRLGLPLVLVVSSYEAIKDCFSTNDAIFSNRPAFLYGEYLGYNNAMLFLANYGPYWRKNRKLVIQEVLSASRLKKFKHVRFARIQTSIKNLYTRIDRNSSTINLTDWLEELNFGLIVKMIAGKNYDS

SEQ ID NO: 473 - DNA, 1277 bp, Nicotiana tabacum
ttgatttacatgtttggtcaagaacataaagaccatcgccgtcgaatggcccctaattttacccctaaagctcttgctacttacactgttatccaacaaaagattattatcaaacactttcagtcctggttggacgaagcatcccaatcccctaacaaaccaatcacacttcgcctcctttgccgcgatatgaacttggatacttcccagactgtcttcgttggtccatacttaaacgaagattccagaaagcagttcaatgttgactacaattacttcaatgttgggttaatgaaactccctgttgatttacctggtttcgccttcagagatgctaggttagctgttgggagactagtcgacacgctttccgtttgtgcagcacagagccaaattaagatgcgaggtgacgaagaacccacttgcttgattgatttttggatgcaggagaatttcagagagattcaggaagctaagattaatggttcacaaaagccgtttgagtataccagtaagcaacttggtggcttcttatttgacttcctctttgcggctcaagatgcttctacttcatctctgttatgggcaatggtgcttttggaatctcacccgcaagttctggagagagtccgagccgaagtggcgaaattctggtcgccagaatctgaggagcagccgttgacggcggagatgcttagggaaatgaagtacctggaggcggtggcgcgtgaggttgttaggatcagaactccggcggctttggtgccgcacattgccggcgaagaattccggttaactgatgattatgttattccaaaggggactattgttttcccttcggtttttgactcgtctttccaggggtttcctgaaccggagaagtttgacccggaccggttcacagaggagaggcaagaggaacgggtttacaagaagaattatctagcatttggagctgggccccatggatgtgtgggacagaggtatgctataaaccatttgatgctctttattgcgttgttcacggctctgattgatttcaagaggcacaaaacggacggctgtgatgatatcgcgtatattccaaccattgctccaaaggatgattgtaaagtgttcctttcacagaggtgcactcgattcccatctttttcatgaactaattgcaccttttatttaattctgatcctcaaattggtcccattggaccatggatgtaataggaccaattgcaagaatggggtccaatgtatttgttctttccatttatttttttt

SEQ ID NO: 474 - protein, 385 aa, Nicotiana tabacum
LIYMFGQEHKDHRRRMAPNFTPKALATYTVIQQKIIIKHFQSWLDEASQSPNKPITLRLLCRDMNLDTSQTVFVGPYLNEDSRKQFNVDYNYFNVGLMKLPVDLPGFAFRDARLAVGRLVDTLSVCAAQSQIKMRGDEEPTCLIDFWMQENFREIQEAKINGSQKPFEYTSKQLGGFLFDFLFAAQDASTSSLLWAMVLLESHPQVLERVRAEVAKFWSPESEEQPLTAEMLREMKYLEAVAREVVRIRTPAALVPHIAGEEFRLTDDYVIPKGTIVFPSVFDSSFQGFPEPEKFDPDRFTEERQEERVYKKNYLAFGAGPHGCVGQRYAINHLMLFIALFTALIDFKRHKTDGCDDIAYIPTIAPKDDCKVFLSQRCTRFPSFS

SEQ ID NO: 475 - DNA, 1204 bp, Nicotiana tabacum
tcattttcagtatgctatgttttgtctacttgtgttgatgtgtttcggggataagctcgacgaggctcaaatcaaacaaattgaaggtgttcagcgcaggttgctcctgggtttccgacgattcaatatactcaatttcttacccagagttgggaaaataatctttaggaatcgctggaaggaactaattgaactacgtcaagagcaagagaagatcttcattcctttgattgaagctcgaagtattagggccaaagaacaaaagcctgaggaagaagtggtggcttatgtggatacgctgttgaatttggaattgccaggggaaaacaggagcctcaattatggggaaatggttagcctctgcagtgaattcctaaacgccggaactgatacgacgtccaccgccttacagtgggttatggccaacttggtcaaaaacccttccattcagggaaaactatatcaagaaattgctagtgtagtgggagagaaacagagcaagttgacagaagaggtggtaaaggaggacgatctgcataaaatgccatacttgagagcagtgatctttcttaggcgacacccgcctggtcactttgtgctgccacatacggtgacagaggaagtagaactgaatggctatgttgtcccgaagaatgccaccatcaatttcatggttgcagacatgggtttggacccaaaggtgtgggaggatcccttggaattcaagccagagaggttcttaatggagggatcagataaggaagggttcgatataacaggaagtagagagatcaagatgatgccatttggcgctggtaggagaatttgcccaggctatgctttggctatgcttcatctagagtactttgtggctaatttggtttggcattttcgatgggaggctgtggagggagatgatgttgatctttcagaaaagctagaattcaccgttgtgatgaagaatccacttcgagctcgtatctgcctcagagttaactctatttgaatttggtaattactagttctttctatttgcattgttccctgttgatggacttcccccatatagtactggaagttagagggagaatgattattaatgccttgctgcaatattagcttagtagttagtagtgaatataattgaaactggatatttctatcttatgtgttgtacatttggttcattgcaaagggcgaattc

SEQ ID NO: 476 - protein, 334 aa, Nicotiana tabacum
HFQYAMFCLLVLMCFGDKLDEAQIKQIEGVQRRLLLGFRRFNILNFLPRVGKIIFRNRWKELIELRQEQEKIFIPLIEARSIRAKEQKPEEEVVAYVDTLLNLELPGENRSLNYGEMVSLCSEFLNAGTDTTSTALQWVMANLVKNPSIQGKLYQEIASVVGEKQSKLTEEVVKEDDLHKMPYLRAVIFLRRHPPGHFVLPHTVTEEVELNGYVVPKNATINFMVADMGLDPKVWEDPLEFKPERFLMEGSDKEGFDITGSREIKMMPFGAGRRICPGYALAMLHLEYFVANLVWHFRWEAVEGDDVDLSEKLEFTVVMKNPLRARICLRVNSI

SEQ ID NO: 477 - DNA, 1066 bp, Nicotiana tabacum
ataaatctaactgattggttagaagaattgaattttggtctgatcgtgaaaatgatcgctgggaaaaattatgaatccggtaaaggagatgaacaagtggaaagatttaagaatgcgtttaaggatttcatggttttatcaatggaatttgtattatgggatgcatttccaattccattatttaaatgggtggattttcaaggtcatattaaggcaatgaaaaggacatttaaggatatagattctgtttttcagaactggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataataacgcctcgcctggcacctgagctttattaaaacctaagatgtttcatcttggttgatcattgtttaatac

SEQ ID NO: 478 - protein, 341 aa, Nicotiana tabacum
INLTDWLEELNFGLIVKMIAGKNYESGKGDEQVERFKNAFKDFMVLSMEFVLWDAFPIPLFKWVDFQGHIKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIITPRLAPELY

SEQ ID NO: 479 - DNA, 994 bp, Nicotiana tabacum
atgagaatggtagctggaaagagatattatggtgaagaggtagataacgaggaggcaaaccattttcgggagcttgtagaagaggttatttcatatgggggtgcatcaaatcccacggatttcatgcctgcaatatttcgttgctttttcaggagtatggagaagaatttggccaggcttggtagcaaaatggacgcgctcttgcaaggcttgattgatgaacaccgtcgtgataaaagcagaaattccatgattgatcatttgctttctctgcaagaatcagaaccagaatattactctgatcaaatcatcaaaggaataatattggtcatgctgaatgcggggactgaaacatcatctgtaacaatagaatgggcaatgtctcttttactcaatcatccagaggtgttggaaaaggccaaagctgaaatagacgaccatgtgggtaaagatcgtttagtggatgaagcagatttacccaagctgaaataccttcaaagtattatttcagagacacttcgattgtaccctgcaggaccaatgctagtgcctcatggatcatctgatgattgcactatcgctgggttgcacattccacgtggcacgatgctattggtgaatgcttgggccatccacagggacccattactttgggaggatccagagagcttcaagccagaaaggtttgaaggtgtgcaagtggaatcatggaagctattgccatttggaatgggaaggagagcgtgtccaggttctggacttgctcaacgtgtggttggtttagctttagcatctctagtgcagtgttttgagtggaaaagggtaagtgaagaggtggttgatttgactgaaggaaaaggtctcaccatgccaaaagctgagccactcatggctaggtgcgaagctcgtgatattcttcacaaagttgtttcagaaatatcctaacgtttcagagtgtttcttgcatttttttagtgctccatacctctagttt

SEQ ID NO: 480 - protein, 314 aa, Nicotiana tabacum
MRMVAGKRYYGEEVDNEEANHFRELVEEVISYGGASNPTDFMPAIFRCFFRSMEKNLARLGSKMDALLQGLIDEHRRDKSRNSMIDHLLSLQESEPEYYSDQIIKGIILVMLNAGTETSSVTIEWAMSLLLNHPEVLEKAKAEIDDHVGKDRLVDEADLPKLKYLQSIISETLRLYPAGPMLVPHGSSDDCTIAGLHIPRGTMLLVNAWAIHRDPLLWEDPESFKPERFEGVQVESWKLLPFGMGRRACPGSGLAQRVVGLALASLVQCFEWKRVSEEVVDLTEGKGLTMPKAEPLMARCEARDILHKVVSEIS

SEQ ID NO: 481 - DNA, 1030 bp, Nicotiana tabacum
ctcctttgccgcgatatgaacttggatacttcccagactgtcttcgttggtccatacttaaacgaagattccagaaagcagttcaatgttgactacaattacttcaatgttgggttaatgaaactccctgttgatttacctggtttcgccttcagagatgctaggttagctgttgggagactagtcgacacgctttccgtttgtgcagcacagagccaaattaagatgcgaggtgacgaagaacccacttgcttgattgatttttggatgcaggagaatttcagagagattcaggaagctaagattaatggttcacaaaagccgtttgagtataccagtaagcaacttggtggcttcttatttgacttcctctttgcggctcaagatgcttctacttcatctctgttatgggcaatggtgcttttggaatctcacccgcaagttctggagagagtccgagccgaagtggcgaaattctggtcgccagaatctgagcagccgttgacggcggagatgcttagggaaatgaagtacctggaggcggtggcgcgtgaggttgttaggatcagaactccggcgactttggtgccgcacattgccggcgaagaattccggttaactgatgattatgttattccaaaggggactattgttttcccttcggtttttgactcgtctttccaggggtttcctgaaccggagaagtttgacccggaccggttcacagaggagaggcaagaggaacgggtttacaagaagaattatctagcatttggagctgggccccatggatgtgtgggacagaggtatgctataaaccatttgatgctctttattgcgttgttcacggctctgattgatttcaagaggcacaaaacggacggctgtgatgatatcgcgtatattccaaccattgctccaaaggatgattgtaaagtgttcctttcacagaggtgcactcgattcccatctttttcatgaactaattgcgccttttatttaattctgatcctcaaattggtcccattgg

SEQ ID NO: 482 - protein, 326 aa, Nicotiana tabacum
LLCRDMNLDTSQTVFVGPYLNEDSRKQFNVDYNYFNVGLMKLPVDLPGFAFRDARLAVGRLVDTLSVCAAQSQIKMRGDEEPTCLIDFWMQENFREIQEAKINGSQKPFEYTSKQLGGFLFDFLFAAQDASTSSLLWAMVLLESHPQVLERVRAEVAKFWSPESEQPLTAEMLREMKYLEAVAREVVRIRTPATLVPHIAGEEFRLTDDYVIPKGTIVFPSVFDSSFQGFPEPEKFDPDRFTEERQEERVYKKNYLAFGAGPHGCVGQRYAINHLMLFIALFTALIDFKRHKTDGCDDIAYIPTIAPKDDCKVFLSQRCTRFPSFS

SEQ ID NO: 483 - DNA, 593 bp, Nicotiana tabacum
  modified_base (80)..(80): a, c, g or t
gatcgtttagtggatgaagcagatttacccaagctgaaataccttcaaagtattatttcagagacacttcgattgtaccntgcagcaccaatgctagtgcctcatgaatcatctgatgattgcacggtcgctggcttccacattcctcgtggcacgatgctattggtgaatgcttgggccatccacagggaccccttactttgggaggacccagagagcttcaagccaaaaaggtttgaaggtgtgcaagccgaatcatggaagctattgccatttggaatgggaaggagagcgtgcccaggttctggacttgctcaatgtgtggttggtttagctttagcaactctagtgcagtgttttgagtggaaaagggtaagcgaagaggtggttgatttgacggaaggaaaaggtctcactatgccaaaacccgagccactcatggctaggtgcgaagctcgtgacatttttcacaaagttctttcagaaatatcttaatgttttgggagtctgaattaataatgtaaaatgtattttcattttctcatataatattgcactatctacatttctgatatgtcattgagatactccgg

SEQ ID NO: 484 - protein, 164 aa, Nicotiana tabacum
  MOD_RES (27)..(27): Leu, Pro, His or Arg
DRLVDEADLPKLKYLQSIISETLRLYXAAPMLVPHESSDDCTVAGFHIPRGTMLLVNAWAIHRDPLLWEDPESFKPKRFEGVQAESWKLLPFGMGRRACPGSGLAQCVVGLALATLVQCFEWKRVSEEVVDLTEGKGLTMPKPEPLMARCEARDIFHKVLSEIS

SEQ ID NO: 485 - DNA, 571 bp, Nicotiana tabacum
gaggacgatctgcataaaatgccatacttgagagcagtgatcttagagggtcttaggcgacacccgcctggtcactttgtgctgccacatacggtgacagaggaagtagaactgaatggctatgttgtcccgaagaatgccaccatcaatttcatggttgcagacatgggtttggacccaaaggtgtgggaggatcccttggaattcaagccagagaggttcttaatggagggatcagataaggaagggttcgatataacaggaagtagagagatcaagatgatgccatttggcgctggtaggagaatttgcccaggctatgctttggctatgcttcatctagagtactttgtggctaatttggtttggcattttcgatgggaggctgtggagggagatgatgttgatctttcagaaaagctagaattcaccgttgtgatgaagaatccacttcgagctcgtatctgcctcagagttaactctatttgaatttggtaattactagttctttctatttgcattgttccctgttgatggacttcccccatatagtactggaagttagagggag

SEQ ID NO: 486 - protein, 162 aa, Nicotiana tabacum
EDDLHKMPYLRAVILEGLRRHPPGHFVLPHTVTEEVELNGYVVPKNATINFMVADMGLDPKVWEDPLEFKPERFLMEGSDKEGFDITGSREIKMMPFGAGRRICPGYALAMLHLEYFVANLVWHFRWEAVEGDDVDLSEKLEFTVVMKNPLRARICLRVNSI

SEQ ID NO: 487 - DNA, 1294 bp, Nicotiana tabacum
gcagtgctgacttggcgtacgaagctttaattgaaaagggtcaaattttcgctacccgcccgagtgagaccccgacccgaaccattttcagttgcaacaagttcagtgtcaatgcagcaatttacgggccactttggcgatccctgagaagaaatatggtccaaaatatgcttagttcgagtagagtgaaagaatttcgtgattgtagagaaatggcaatggataagttgattgaaaggatacatgcagatgctaaggccaataacgatatcgtttgggtgctgaaaaacgcgcgtttcgcggtgttttatatacttttgactatgtgttttggtgttgaaatggatgagaaaatgattgaaaccgttgatcaaatgatgaaggatgtgctaatggagcttcatccaagaatagatgattttcttcctatattgagcttgtttgttggttataaacaacgtaagagagttcacgaagttcgcaagagacaaatagaaacacttgtccctttgatcgagaaacgtcgaagagcaatacaaaatcctgggtacgataagacagttgcctcgttttcgtacttagatactttatttgatgttaaggtcgaaggtacaaagtcaggaccaacgaatccggagcttgtaacactatgttcagagttcttgaatggtgggaccgacacaaccgctaccgcaatagagtgggccatagggagaatgatcgaaaatccaagcatacagaagagaatatacgaagagattagaaatacagtgggtgacagaaagattgacgaaaaggatatggataagatgccttatttaaacgccgttgtaaaggagcttttacgtaaacatcctcctacgtacgttacatttacccatgcagtaacggagccaacaacattgggtgggtatgacatacccacatatgctaatgtagagttttttgtacccgggatctcggatgacccgaaagtttggtctgatccggaaaagtttgacccggataggtttctatccgggcgggaggacgctgatataacgggtgtgaccggggtaaagatgatgccatttggggtcgggcggaggatttgtccgggcttgggcttggcaacggtgcatgtgaatttgatgttggcccgaatgattcaagaatttgaatggtccgcttacccggaaaataggaaagtggattttactgagaaattggaatttactgtggtgatgaaaaaccctttaagagctaaggtcaagccaagaatgcaagtggtgtaattcattaagattataagtcc

SEQ ID NO: 488 - protein, 423 aa, Nicotiana tabacum
SADLAYEALIEKGQIFATRPSETPTRTIFSCNKFSVNAAIYGPLWRSLRRNMVQNMLSSSRVKEFRDCREMAMDKLIERIHADAKANNDIVWVLKNARFAVFYILLTMCFGVEMDEKMIETVDQMMKDVLMELHPRIDDFLPILSLFVGYKQRKRVHEVRKRQIETLVPLIEKRRRAIQNPGYDKTVASFSYLDTLFDVKVEGTKSGPTNPELVTLCSEFLNGGTDTTATAIEWAIGRMIENPSIQKRIYEEIRNTVGDRKIDEKDMDKMPYLNAVVKELLRKHPPTYVTFTHAVTEPTTLGGYDIPTYANVEFFVPGISDDPKVWSDPEKFDPDRFLSGREDADITGVTGVKMMPFGVGRRICPGLGLATVHVNLMLARMIQEFEWSAYPENRKVDFTEKLEFTVVMKNPLRAKVKPRMQVV

SEQ ID NO: 489 - DNA, 1825 bp, Nicotiana tabacum
acagcatcttgtgctgccataataattactctagtggtgtgtatatggagagtgctgaattgggtttggttcagaccaaagaagctggaaaagctactgaggaaacaaggtctcaaaggcaattcctacaggattttgtatggggatatgaaggagctttctggtatgattaaggaagctaactccaaacccatgaatctttctgatgatattgccccaagattggtccctttctttcttgataccatcaagaaatatgggaaaaaatcctttgtatggttgggtccaaaaccgctggtttttgtcatggaccccgagcttataaaggaagtattctccaaaaactatctgtatcaaaagcctcattcaaatccattaaccaagttactggcacaaggacttgtaagccaagaggaagacaaatgggccaaacatagaaaaatcgtcactcctgccttccacctggagaagctaaaggtttgtaattgcaatggattctccgtaagcagttcatttttatcttttctttcatcgtaacagaaacttactcttgattgtgattcttttttgaggtacttgtttggaaccattttgtattcctaattacaaagtcggaacattttgaataagtgtcccttcattgactttctcttaaccatttcttaaacagcatatgcttccagctttttgtttgagctgtactgagatgctgagcaaatgggaagacattgttgcagttgagggctcacatgagatagatatatggcctggccttcaacaattaactagtgatgtgatctctcggacagcctttggcagtagctatgaagcaggtagaaggatatttgaacttcaaaaggaacaagctcaatttcttatggaagctatacgctccgtttatattccaggctggaggtttttgccaacaaagaggaacagaagaatgaaggaaattgaaaaggatgttcaagccttagttaaaggtattattgataaaagagtaaagtcaatgaaagcaggagaggtgaataatgaggatctgcttggtatattgctggaatctaattttaaagaaattgaacagcatggaaacaaggattttggaatgagcattgaagaagtcattcaagaatgcaagttattctattttgctggccaagaaactacatcagtgttgcttgtatggactctaatattgctgagcaggcatcaggattggcaagcactggccagagaagaggtgttgcaagtctttgggaatcagaaaccagattttgatggattaaatcgtctaaaaattgttacaatgatcttgtacgagtctttaaggctctatcccccagtagtgacacttacccgaaggcctaaggaagacactgtattaggagatgtatctctaccagcaggtgtgttaatctccttaccagtgatcttattgcatcacgacgaagagatatggggtaaagatgcaaagaagttcaagccagagagattcagagatggagtctcaagtgcaacaaagggtcaagtcacttttttcccatttacttggggtcccagaatatgcattggacaaaattttgccatgttagaagcaaagactactttggctatgatcctacaacgcttctcctttgaactgtctccatcttatgcacatgctcctcagtccataataactttgcaaccccagtatggtgctccacttattttgcataaaatatagtttattacttgtaagtagtgtctcgttttatgttaagcatgagtccaaaatgttaaggcttgtagaactgcaaaatgggaatgaatcactagtgaattc

SEQ ID NO: 490 - protein, 353 aa, Nicotiana tabacum
KQHMLPAFCLSCTEMLSKWEDIVAVEGSHEIDIWPGLQQLTSDVISRTAFGSSYEAGRRIFELQKEQAQFLMEAIRSVYIPGWRFLPTKRNRRMKEIEKDVQALVKGIIDKRVKSMKAGEVNNEDLLGILLESNFKEIEQHGNKDFGMSIEEVIQECKLFYFAGQETTSVLLVWTLILLSRHQDWQALAREEVLQVFGNQKPDFDGLNRLKIVTMILYESLRLYPPVVTLTRRPKEDTVLGDVSLPAGVLISLPVILLHHDEEIWGKDAKKFKPERFRDGVSSATKGQVTFFPFTWGPRICIGQNFAMLEAKTTLAMILQRFSFELSPSYAHAPQSIITLQPQYGAPLILHKI

SEQ ID NO: 491 - DNA, 920 bp, Nicotiana tabacum
catcaacgagcacaagaaaaatcttgcagctggcaagagtaatggtgcattaggaggtgaagatctaattgatgtcctactaagacttaagaatgatacaagtcttcaatttcccatcaccaacaacagtatcaaagctgttattgttgacatgtttgctgccggaacggaaacttcatcaacaacaactgtatgggctatggctgaaatgatgaagaatccaagtgtattcaccaaagctcaagcagaagtgcgagaagcctttagggacaaagtatcttttgatgaaaacgatgtggaggagctgaaatacttaaagttagtcattaaagaaactttgagacttcatccaccctctccacttttggtcccaagagaatgcagggaagacacagatataaacggctacactattcctgcgaagaccaaagttatggttaatgtttgggcattgggaagagatccaaaatattgggatgacgccgaaagctttaagccagagagatttgagcaatgctctatggatttttttggtaataattttgagtttcttccctttggtggtggacggagaatttgtcctggaatgtcatttggtttagctaatctttacttgccattggcccaattgctgtatcacttcgactggaaactcccaactggaatcaagccaagagacttggacttgactgaattatctggaataactattgctagaaagggtgacctttacttaaatgccactccttatcaaccgtcgagactaatttaatattggcatcaactttttaaattttcttcatcaacctcattattaatgtacaataatctttcttctgttgttgtaggctttatcgatttccaatacatgtattctttatttaaaaatgtatcacattccatgtataaaaaaaaaaaaa

SEQ ID NO: 492 - protein, 256 aa, Nicotiana tabacum
INEHKKNLAAGKSNGALGGEDLIDVLLRLKNDTSLQFPITNNSIKAVIVDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSMDFFGNNFEFLPFGGGRRICPGMSFGLANLYLPLAQLLYHFDWKLPTGIKPRDLDLTELSGITIARKGDLYLNATPYQPSRLI

SEQ ID NO: 493 - DNA, 1394 bp, Nicotiana tabacum
aaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggactccgctgcccgaccaacttctatggctggtgaaagcatcgggtacaagtatgcgaggtttacttatgctaattttggtccttattataaccaagtgcgcaaactagccctacaacatgtactctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgatcctgaaatttggtcagagcccgaaaagtttatgcccaatagattcttgactagcaaagcaaatatagatgctcgcggtcaaaattttgaatttataccgtttggttctgggagacggtcatgtccagggataggt

SEQ ID NO: 494 - protein, 463 aa, Nicotiana tabacum
MDYHISFHFQALLGLLAFVFLSIILWRRTLTSRKLAPEIPGAWPIIGHLRQLSGTDKNIPFPRILGALADKYGPVFTLRIGMYPYLIVNNWEAAKDCLTTHDKDSAARPTSMAGESIGYKYARFTYANFGPYYNQVRKLALQHVLSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIEDTDIKNLVYLQAIVKETLRLYPPVPFLLPHEAVQDCKVTGYHIPKGTRLYINAWKVHRDPEIWSEPEKFMPNRFLTSKANIDARGQNFEFIPFGSGRRSCPGIG

SEQ ID NO: 495 - DNA, 480 bp, Nicotiana tabacum
aataggccaaaatatatggaaggagatattgttgatcttttgctacaattgaagaaagaacaatcaacaccaattgatcttactttggaggatataaaaggaattctcatgaatgtgttggttgcaggatcagacactagtgcagctgctactgtttgggcaatgacagccttgataaaaaatccaaaaaccatgaaaaaagttcaatcagaaatcagaaaatcaatagggaagaaaggaattgtaaatgaagaagatgtccaaaacatgccttatctcaaagcagtgataaaggaaatatttagattgtatccaccagttccacttctagttccaagagaatcaatggaaaaaaccatattagaaggttatgaaattcggccaggaaccatagttcatgttaacgcttgggctattgcgagggatcctgaaatatgggaaaatccagaagaatttatacctgagagattacttgaatag

SEQ ID NO: 496 - protein, 159 aa, Nicotiana tabacum
NRPKYMEGDIVDLLLQLKKEQSTPIDLTLEDIKGILMNVLVAGSDTSAAATVWAMTALIKNPKTMKKVQSEIRKSIGKKGIVNEEDVQNMPYLKAVIKEIFRLYPPVPLLVPRESMEKTILEGYEIRPGTIVHVNAWAIARDPEIWENPEEFIPERLLE

SEQ ID NO: 497 - DNA, 736 bp, Nicotiana tabacum
gcaagttctttcactagttgtaatagtcctatacattcttcaacaattacacaacaaattcatgaaaaagaaaaagaaacttcctccaggtccaaaagggtttccaattattggaaatctatttatgattggcaaaaacctacatcaagatctttatcaaatagccaaaaaacatggtcctataatgagtatgagatttggtctagttcctatcattgttgcttcatctcctcatgctgctgaactattcttgaaaaaacatgatcttgtttttgctagtagaccatataatacagctgctcaatatattggatataatcaaagaaatcttacttttggtaaatatggtccttattggcgaaatatgcgaaaattatgtacgttagaattgcttagtagtctcaagatcaattcatttcaggccatgagaaaacaagaaattggaaattttgtgacttttctcaatagagcagcttctaatggtattgaggttgatattagtgctaaacttgcttcattaagtgcaaatatggcttgtttaatggtatttgggaagaaatatatggatgaagaatttgatgaaaggggttttaaagatgtaattcaagagacattagttataactgcaacaccaaatattggtgagttttttccttttcttgataggtttgatttgcagggatttgttccacgtatgaaaaaattggcaaagatttttgatgattttttcgagaaa

SEQ ID NO: 498 - protein, 245 aa, Nicotiana tabacum
QVLSLVVIVLYILQQLHNKFMKKKKKLPPGPKGFPIIGNLFMIGKNLHQDLYQIAKKHGPIMSMRFGLVPIIVASSPHAAELFLKKHDLVFASRPYNTAAQYIGYNQRNLTFGKYGPYWRNMRKLCTLELLSSLKINSFQAMRKQEIGNFVTFLNRAASNGIEVDISAKLASLSANMACLMVFGKKYMDEEFDERGFKDVIQETLVITATPNIGEFFPFLDRFDLQGFVPRMKKLAKIFDDFFEK

SEQ ID NO: 499 - DNA, 509 bp, Nicotiana tabacum
cgtgaatccattgaagattgtattgttgatggttttgatatacctaaaggttcaagaattttagtaaatacttgggcaattggaagagatccagaagcctggcccgaacccgagaagttcaagccagaaaggtttgttggtagcaacatcgatcttaggggacgtgattttcaacttttaccatttggctcagggagaaggagttgccccggattacaattagggctcaccattgttcgcttggtgttagcgcaattggttcattgctttgattgggaactaccaaatggtatggcgccagaagatttagatatgactgagaaatttggtttagttacagctagagctcaacatttagttgctattcctacttatcaattgcatgtgtagttgatgtgaatcttcctagaagcttaattaagtaaaaatgaagatctttgtcctctatatttttcattgtatgacaaaatttggtaacatttactacatatggagctaccactaaaaaa

SEQ ID NO: 500 - protein, 129 aa, Nicotiana tabacum
RESIEDCIVDGFDIPKGSRILVNTWAIGRDPEAWPEPEKFKPERFVGSNIDLRGRDFQLLPFGSGRRSCPGLQLGLTIVRLVLAQLVHCFDWELPNGMAPEDLDMTEKFGLVTARAQHLVAIPTYQLHV

SEQ ID NO: 501 - DNA, 532 bp, Nicotiana tabacum
tcgacgactataatttgggcattagctgaaatgatgaagaaaccaagtgttttagcaaaggcacaagctgaagtaaggcaagctttgaaggagaaaaaaggttttcaacagattgatcttgatgagctaaaatatctcaagttagtaatcaaagaaaccttaagaatgcaccctccaattcctctattagttcctagagaatgtatggaggatacaaagattgatggttacaatatacctttcaaaacaagagtcatagttaatgcatgggcaatcggacgagatccagaaagttgggatgaccccgaaagctttatgccagagagatttgagaatagttctattgactttcttggaaatcatcatcagtttataccatttggtgcaggaagaaggatttgtccgggaatgctatttggtttagctaatgttggacaacctttagctcagttactttatcacttcgattggaaactccctaatggacaaagtcatgagaatttcgacatgactgagtcacctggaatttctg

SEQ ID NO: 502 - protein, 177 aa, Nicotiana tabacum
STTIIWALAEMMKKPSVLAKAQAEVRQALKEKKGFQQIDLDELKYLKLVIKETLRMHPPIPLLVPRECMEDTKIDGYNIPFKTRVIVNAWAIGRDPESWDDPESFMPERFENSSIDFLGNHHQFIPFGAGRRICPGMLFGLANVGQPLAQLLYHFDWKLPNGQSHENFDMTESPGIS

SEQ ID NO: 503 - DNA, 1518 bp, Nicotiana tabacum
tgctctttctactctttgtagcccttcctttcattcttatttttcttcttcctaaattcaaaaatggtggaaataacagattgccaccaggtcctataggtttaccattcattggaaatttgcatcaatacgatagtataactcctcatatctatttttggaaactttcaaaaaaatatggcaaaatcttctcattaaaacttgcttctactaatgtggtagtagtttcttcagcaaaattagcaaaagaagtattgaaaaaacaagatttaatattttgtagtagaccatctattcttggccaacaaaaactgtcttattatggtcgtgatattgcttttaatgattattggagagaaatgagaaaaatttgtgttcttcatctttttagtttaaaaaaagttcaattatttagtccaattcgtgaagatgaagtttttagaatgattaagaaaatatcaaaacaagcttctacttcacaaattattaatctgagtaatttaatgatttcattaacaagtacaattatttgtagagttgcttttggtgttaggattgaagaagaagcacatgcaaggaagagatttgattttcttttggccgaggcacaagaaatgatggctagtttctttgtatctgatttttttccctttttaagttggattgataaattaagtggattgacatatagacttgagaggaatttcaaggatttggataatttttatgaagaactcattgagcaacatcaaaatcctaataagccaaaatatatggaaggagatattgttgatcttttgctacaattgaagaaagagaaattaacaccacttgatctcactatggaagatataaaaggaattctcatgaatgtgttagttgcaggatcagacactagtgcagctgctactgtttgggcaatgacagccttgataaagaatcctaaagccatggaaaaagttcaattagaaatcagaaaatcagttgggaagaaaggcattgtaaatgaagaagatgtccaaaacatcccttattttaaagcagtgataaaggaaatatttagattgtatccaccagctccacttttagttccaagagaatcaatggaaaaaaccatattagaaggttatgaaattcggccaagaaccatagttcatgttaacgcttgggctatagcaagggatcctgaaatatgggaaaatccagatgaatttatacctgagagatttttgaatagcagtatcgattacaagggtcaagattttgggttacttccatttggtgcaggcagaagaggttgcccaggtattgcacttggggttgcatccatggaacttgctttgtcaaatcttctttatgcatttgattgggagttgccttatggagtgaaaaaagaagacatcgacacaaacgttaggcctggaattgccatgcacaagaaaaacgaactttgccttgtcccaaaaaattatttataaattatattgggacgtggatctcatgctagttctgtgaagg

SEQ ID NO: 504 - protein, 491 aa, Nicotiana tabacum
LFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFNDYWREMRKICVLHLFSLKKVQLFSPIREDEVFRMIKKISKQASTSQIINLSNLMISLTSTIICRVAFGVRIEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFGLLPFGAGRRGCPGIALGVASMELALSNLLYAFDWELPYGVKKEDIDTNVRPGIAMHKKNELCLVPKNYL

SEQ ID NO: 505 - DNA, 987 bp, Nicotiana tabacum
ctcattatccatcacctaaaatggagaattcttgggtttttctagccttggcagggctatctgcattagcttttctctgtaaaataatcacctgtcgaagaccggttaaccggaaaataccaccaggtccaaaaccatggcccatcattggcaatttgaacctacttggtcctataccacatcaatcttttgacttgctttccaaaaaatatggagagttgatgctgctgaaatttggctccaggccagttcttgttgcttcatctgctgaaatggcaaaacagtttttaaaagtacatgatgctaatttcgcctcccgtcctatgctagctggtggaaagtatacaagctataactattgtgacatgacatgggcaccctatggtccctattggcgccaagcacgacgaatttaccttaaccagatatttactccgaaaaggctagactcgttcgagtacattcgtgttgaagaaaggcaggccttgatttcccagctgaattcccttgctggaaagccattttttctcaaagaccatttgtcgcgatttagcctctgcagcatgacaaggatggttttgagcaacaagtattttggtgaatcaacagttagagtagaagatttgcagtacctggtagatcaatggttcttacttaatggtgctttcaacattggagattggattccatggctcagcttcttggacctacaaggctatgtgaaacaaatgaaggctttgaaaagaacttttgataagttccacaacattgtgctagatgatcacagggctaagaagaatgcagagaagaactttgtcccaaaagacatggttgatgtcttgttgaagatggctgaagatcctaatctggaagtcaaactcactaatgactgtgtcaaagggttaatgcaggatttactaactggaggaacagatagcttaacagcagcagtgcaatgggcatttcaagaacttcttagacagccaa

SEQ ID NO: 506 - protein, 322 aa, Nicotiana tabacum
MENSWVFLALAGLSALAFLCKIITCRRPVNRKIPPGPKPWPIIGNLNLLGPIPHQSFDLLSKKYGELMLLKFGSRPVLVASSAEMAKQFLKVHDANFASRPMLAGGKYTSYNYCDMTWAPYGPYWRQARRIYLNQIFTPKRLDSFEYIRVEERQALISQLNSLAGKPFFLKDHLSRFSLCSMTRMVLSNKYFGESTVRVEDLQYLVDQWFLLNGAFNIGDWIPWLSFLDLQGYVKQMKALKRTFDKFHNIVLDDHRAKKNAEKNFVPKDMVDVLLKMAEDPNLEVKLTNDCVKGLMQDLLTGGTDSLTAAVQWAFQELLRQP

SEQ ID NO: 507 - DNA, 980 bp, Nicotiana tabacum
atgatcgctgggaaaaattatggatccggtaaaggagatgaacaagtggagagatttgggaaagcgtttaaggattttataattttatcaatggagtttgtgttatgggatgcttttccaattccattgttcaaatgggtggatcttcaaggccatgttaaggccatgaaaaggacatttaaggatatagattctgtttttcagaattggttagaggaacatgtcaagaaaaaagaaaaaatggaggttaatgcagaaggaaatgaacaagatttcattgatgtggtgctttcaaaaatgagtaatgaatatcttgatgaaggctactctcgtgatactgtcataaaagcaacagtgtttagtttagtcttggatgctgcggacacagttgctcttcacatgaattggggaatggcattattgacaaacaatcaacatgccttgaagaaagcgcaagaagagatagataaaaaagttggtaaggatagatgggtagaagagagtgatattaaggatttggtatacctccaaactattgttaaagaagtgttacgattatatccaccgggacctttattagtaccccatgaaaatgtagaggattgtgttgttagtggatatcacattcctaaagggactagactattcgcgaacgttatgaaattacagcgcgatcctaaactctggtcaaatcctgataagttcgatccagagagatttttcgctgctgatattgactttcgtggtcaacactatgagtttatcccatttggttctggaagacgatcttgtccggggatgacttatgcaatgcaagtggaacacctaacaatcgcacacttgatccagggtttcaattacaaaactccaaatgacgagcccttggatatgaaggaaggtgcaggattaactatacgtaaggtaaatcctatagaagtggtaattacgcctcgcctgacacctgagctttattaaaatct

SEQ ID NO: 508 - protein, 324 aa, Nicotiana tabacum
MIAGKNYGSGKGDEQVERFGKAFKDFIILSMEFVLWDAFPIPLFKWVDLQGHVKAMKRTFKDIDSVFQNWLEEHVKKKEKMEVNAEGNEQDFIDVVLSKMSNEYLDEGYSRDTVIKATVFSLVLDAADTVALHMNWGMALLTNNQHALKKAQEEIDKKVGKDRWVEESDIKDLVYLQTIVKEVLRLYPPGPLLVPHENVEDCVVSGYHIPKGTRLFANVMKLQRDPKLWSNPDKFDPERFFAADIDFRGQHYEFIPFGSGRRSCPGMTYAMQVEHLTIAHLIQGFNYKTPNDEPLDMKEGAGLTIRKVNPIEVVITPRLTPELY

SEQ ID NO: 509 - DNA, 513 bp, Nicotiana tabacum
gcagtgatcttagaaggtcttaggcgacacccgcccggtcactttgtgctgccacatacggtgacagaggaagcagaactgaacggctacgtcgtcccaaagaatgccaccatcaatttcatggttgccgacatgggtttggacccaaaggtgtgggaggatcccttggaatttaagccagagaggttcttaatggagggatcagataaggaagggtttgatataacaggaagtagagagatcaagatgatgccatttggagctggtaggagaatatgtcctggctatgctttggctatgcttcatttggaatactttgtggctaatttggtttggcattttcgatgggatgctgtggagggagatgatgttgatctttcagagaagctagaattcaccgttgtgatgaagaatcctctacgagctcgtatctgccctagagttaactctgtttgaatttggtaattactagtagttctttctatttgcattgttccctgttgatggacttcc

SEQ ID NO: 510 - protein, 151 aa, Nicotiana tabacum
AVILEGLRRHPPGHFVLPHTVTEEAELNGYVVPKNATINFMVADMGLDPKVWEDPLEFKPERFLMEGSDKEGFDITGSREIKMMPFGAGRRICPGYALAMLHLEYFVANLVWHFRWDAVEGDDVDLSEKLEFTVVMKNPLRARICPRVNSV

SEQ ID NO: 511 - DNA, 419 bp, Nicotiana tabacum
ttcgcatggataggcccagaacccaggattttcgtaatgaaaccagaattgataaaggaaatagtaacgaacaacaccatcttcaaaaaaccaaaaccagccccacttgtccagcttcttgttagtggcatctcaagttatgaggacgacaaatgggctaagcacagaaaaattcttaacactgcattttacgccgagaagttgaagtgtatgctgccggcaatgcacacaagctgtgaagatatgatcaacaagtgggaaattctactctccgaaaacaaatcctgcgaattggacgtgcatccatattttgaagattttaccagtgatgtgatttcaagaacagcatttggaagtagttatgcagaaggaacaagaatatttcatcttcaaaaagaactagctgaactcacacgcca

SEQ ID NO: 512 - protein, 139 aa, Nicotiana tabacum
FAWIGPEPRIFVMKPELIKEIVTNNTIFKKPKPAPLVQLLVSGISSYEDDKWAKHRKILNTAFYAEKLKCMLPAMHTSCEDMINKWEILLSENKSCELDVHPYFEDFTSDVISRTAFGSSYAEGTRIFHLQKELAELTR

SEQ ID NO: 513 - DNA, 557 bp, Nicotiana tabacum
atgagtttagtaaaatcagtagtgtatgaagtattaagaattgaacctccagttccattccaatatggtaaagccaaagaagatatcataatccaaagccatgattcaactttcttagtcaagaaaggtgaaatgatctttggatatcagccttttgctacaaaagatccaaagatttttgacaaaccagaggagtttattccggagaggttcatggccgaaggggaaaaattattaaagtatgtgtattggtcaaatgcaagagagacagatgatccaacggtggacgacaaacaatgcccagcgaaaaatcttgtcgtgcttttgtgcaggttgatgttggtggaggttttcatgcgttacgacacattcacagtggagtcaacaaagctctttcttgggtcatcagtaacgttcacgactctggaaaaagcgacatgagtttcagatatcttaattgtaggctgcaaataataatgtggtcattctgcaaattattgtacttgtgctgatgtacttgacttcgagtggatataataatgcactgtttttagaaa

SEQ ID NO: 514 - protein, 146 aa, Nicotiana tabacum
MSLVKSVVYEVLRIEPPVPFQYGKAKEDIIIQSHDSTFLVKKGEMIFGYQPFATKDPKIFDKPEEFIPERFMAEGEKLLKYVYWSNARETDDPTVDDKQCPAKNLVVLLCRLMLVEVFMRYDTFTVESTKLFLGSSVTFTTLEKAT

SEQ ID NO: 515 - DNA, 389 bp, Nicotiana tabacum
gttggaacaagtagttggcacaaacagaatggtggaagaatcagatttggaaaaattagattacttagatatggttgtaaaagaaggttttaggcttcaccctgttgcaccactattacttcctcgtgaatccattgaagattgtattgttgatggttttgatatacctaaaggttcaagaattttagtaaatacttgggcaattggaagagatccagaagcctggcccgaacccgagaagttcaagccagaaaggtttgttggtagcaacatcgatcttaggggacgtgattttcaacttttaccatttggctcagggagaaggagttgccccggattacaattagggctcaccattgttcgcttggtgttagcgcaattggttcatt

SEQ ID NO: 516 - protein, 129 aa, Nicotiana tabacum
LEQVVGTNRMVEESDLEKLDYLDMVVKEGFRLHPVAPLLLPRESIEDCIVDGFDIPKGSRILVNTWAIGRDPEAWPEPEKFKPERFVGSNIDLRGRDFQLLPFGSGRRSCPGLQLGLTIVRLVLAQLVH

SEQ ID NO: 517 - DNA, 405 bp, Nicotiana tabacum
ctatatggagacacaaaggagatggctgagatgaccaaagaagccaagtttaaacccattaaactcactgatgatattctccctcggatcttccctttctaccatcatactttcaacaaatatggtaaccattgtttcgcatggataggcccagaacccaggattttcgtaatgaaaccagaattgataaaggaaatagtaacgaacaacaccatcttcaaaaaaccaaaaccagccccacttgtccagcttcttgttagtggcatctcaagttatgaggacgacaaatgggctaagcacggaaaaattcttaacactgcattttacgccgagaagttgaagtgtatgctgccggcaatgcacacaagctgtgaagatatgatcaacaagtgggaaattctactc

SEQ ID NO: 518 - protein, 135 aa, Nicotiana tabacum
LYGDTKEMAEMTKEAKFKPIKLTDDILPRIFPFYHHTFNKYGNHCFAWIGPEPRIFVMKPELIKEIVTNNTIFKKPKPAPLVQLLVSGISSYEDDKWAKHGKILNTAFYAEKLKCMLPAMHTSCEDMINKWEILL

SEQ ID NO: 519 - DNA, 445 bp, Nicotiana tabacum
tacgtacgttacatttacccatgcagtaacggagccaacaacattgggtgggtatgacatacccacatatgctaatgtagagttttttgtacccgggatctcggatgacccgaaagtttggtctgatccggaaaagtttgacccggataggtttctatccgggcgggaggacgctgatataacgggtgtgaccggggtaaagatgatgccatttggggtcgggcggaggatttgtccgggcttgggcttggcaacggtgcatgtgaatttgatgttggcccgaatgattcaagaatttgaatggtccgcttacccggaaaataggaaagtggattttactgagaaattggaatttactgtggtgatgaaaaatcctttaagagctaaggtcaagccaagaatgcaagtggtgtaattcattaagattataagtccaaaaataagc

SEQ ID NO: 520 - protein, 137 aa, Nicotiana tabacum
TYVTFTHAVTEPTTLGGYDIPTYANVEFFVPGISDDPKVWSDPEKFDPDRFLSGREDADITGVTGVKMMPFGVGRRICPGLGLATVHVNLMLARMIQEFEWSAYPENRKVDFTEKLEFTVVMKNPLRAKVKPRMQVV

SEQ ID NO: 521 - DNA, 574 bp, Nicotiana tabacum
agaagagatagacatgaaagtgggtaaagagaggtggattgaagatactgacataaaaaatttagtgtaccttcaggctatcgttaaagagacattgcgcttgtatccacctgttccttttcttttaccacacgaagcagtgcaagattgtaaagtgactggttaccacattcctaaaggtactcgtctatatatcaatgcgtggaaagtacatcgcgatcctgaaatttggtcagagcccgaaaagtttatgcccaatagattcttgactagcaaagcaaatatagatgctcgcggtcaaaattttgaatttataccgtttggttctgggagacggtcatgtccagggataggttttgcgactttagtgacacatctgacttttggtcgcttgcttcaaggttttgattttagtaagccatcaaacacgccaattgacatgacagaaggcgtaggcgttactttgcctaaggttaatcaagttgaagttctaattatccctcgtttaccttctaagctttatttattttgaaagtgcaaatcatcaatcatgggttgagtaattagtgatact

SEQ ID NO: 522 - protein, 176 aa, Nicotiana tabacum
EEIDMKVGKERWIEDTDIKNLVYLQAIVKETLRLYPPVPFLLPHEAVQDCKVTGYHIPKGTRLYINAWKVHRDPEIWSEPEKFMPNRFLTSKANIDARGQNFEFIPFGSGRRSCPGIGFATLVTHLTFGRLLQGFDFSKPSNTPIDMTEGVGVTLPKVNQVEVLIIPRLPSKLYLF

SEQ ID NO: 523 - DNA, 1137 bp, Nicotiana tabacum
aacatttggcaatatagtcttcctcctcagttcttgcctcctgttccttagaaataatggattatcatatttctttccatcttccaactctttttgggctttttgcctttgtgttcttgtctattatcttatggagaagaacactcaattcaagaagattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttcgctgcccgaccaacttctatggctggtgaaagcatcgggtacaagtatgcgaggtttacttatgctaattttggtccttattataaccaagtgcgcaaactagccctacaacatgtactctcgagtactaaactcgagaaaatgaaacacatacgtgtttctgaattggaaactagcatcaaagaattatattctttgacgctgggcaaaaacaacatgcaaaaagtgaatataagtaaatggtttgaacaattgactttaaacataatcgtgaagacaatttgtggcaagagatatagcaacatagaggaggatgaagaggcacaacgtttcagaaaggcatttaagggcatcatgtttgttgtagggcaaattgttttatatgacgcaattccattcccattgttcaaatactttgatttccaaggtcatatacaattgatgaacaaaatttataaagacttagattctattcttcaaggatggttggatgatcatatgatgaacaaggatgtaaacaataaggatcaagatgccatagatgccatgcttaaggtaacacaacttaatgaattcaaagcctatggtttttctcaggccactgtgatcaagtcgacagtcttgagtttgatcttagatggaaatgacacaaccgctgttcatttgatatgggtaatgtccttattactgaacaatccacatgttatgaaacaaggccaagaagagatagacatgaaagtgggtaaagagaggtggattgaagata

SEQ ID NO: 524 - protein, 360 aa, Nicotiana tabacum
MDYHISFHLPTLFGLFAFVFLSIILWRRTLNSRRLAPEIPGAWPIIGHLRQLSGTDKNIPFPRILGALADKYGPVFTLRIGMYPYLIVNNWEAAKDCLTTHDKDFAARPTSMAGESIGYKYARFTYANFGPYYNQVRKLALQHVLSSTKLEKMKHIRVSELETSIKELYSLTLGKNNMQKVNISKWFEQLTLNIIVKTICGKRYSNIEEDEEAQRFRKAFKGIMFVVGQIVLYDAIPFPLFKYFDFQGHIQLMNKIYKDLDSILQGWLDDHMMNKDVNNKDQDAIDAMLKVTQLNEFKAYGFSQATVIKSTVLSLILDGNDTTAVHLIWVMSLLLNNPHVMKQGQEEIDMKVGKERWIED

SEQ ID NO: 525 - DNA, 254 bp, Nicotiana tabacum
gtaaatgaagaagatgtccaaaacatcccttattttaaagcagtgataaaggaaatatttagattgtatccaccagctccacttttagttccaagagaatcaatggaaaaaaccatattagaaggttatgaaattcggccaagagccatagttcatgttaacgcttgggctatagcaagggatcctgaaatatgggaaaatccagatgaatttatacctgagagatttttgaatagcagtatcgattacagggt

SEQ ID NO: 526 - protein, 84 aa, Nicotiana tabacum
VNEEDVQNIPYFKAVIKEIFRLYPPAPLLVPRESMEKTILEGYEIRPRAIVHVNAWAIARDPEIWENPDEFIPERFLNSSIDYR

SEQ ID NO: 527 - DNA, 519 bp, Nicotiana tabacum
aagagtaatggtgcattaggaggtgaagatctaattgatgtcctactaagacttaagaatgatacaagtcttcaatttcccatcaccaacaacaatatcaaagctgttattgttgacatgtttgctgccggaacggaaacttcatcaacaacaactgtatgggctatggctgaaatgatgaagaatccaagtgtattcaccaaagctcaagcagaagtgcgagaagcctttagggacaaagtatcttttgatgaaaacgatgtggaggagctgaaatacttaaagttagtcattaaagaaactttgagacttcatccaccctctccacttttggtcccaagagaatgcagggaagacacagatataaacggctacactattcctgcgaagaccaaagttatggttaatgtttgggcattgggaagagatccaaaatattgggatgacgccgaaagctttaagccagagagatttgagcaatgctctatggatttttttggtaataattttgagtttctt

SEQ ID NO: 528 - protein, 174 aa, Nicotiana tabacum
KSNGALGGEDLIDVLLRLKNDTSLQFPITNNNIKAVIVDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSMDFFGNNFEFLP

SEQ ID NO: 529 - DNA, 340 bp, Nicotiana tabacum
ttaaaccaccctgaaactctgaagaaagcacaagctgaaattgatgaacatataggacatgaacgtttagtggacgagtcggacatcaacaacctaccttacctacgttgtataatcaacgagacattccgaatgtaccctgcaggaccactactagtcccacacgagtcgtcagaggaaaccaccgtaggaggctaccgtgtacccggaggaaccatgttacttgtgaatttgtgggctattcacaatgatccaaagctatgggatgaaccaagaaagtttaagccagaaagatttgaaggactagaaggtgttagagatggttacaaaatgatgccct

SEQ ID NO: 530 - protein, 113 aa, Nicotiana tabacum
LNHPETLKKAQAEIDEHIGHERLVDESDINNLPYLRCIINETFRMYPAGPLLVPHESSEETTVGGYRVPGGTMLLVNLWAIHNDPKLWDEPRKFKPERFEGLEGVRDGYKMMP

SEQ ID NO: 531 - DNA, 218 bp, Nicotiana tabacum
gtcaggtttcatcctatagctccagtattagcacctagagaatcaagggaagagtgtgagattaatggctatgttataccaaaaggcacaatggcccttgtgaatttttgggcaatttctagggatccaaattattggtcaaatcctgaaacatttgatccagagagatttaatgaaagtcaccttgattttactggagctcatttcgagtttacgcc

SEQ ID NO: 532 - protein, 72 aa, Nicotiana tabacum
VRFHPIAPVLAPRESREECEINGYVIPKGTMALVNFWAISRDPNYWSNPETFDPERFNESHLDFTGAHFEFT

SEQ ID NO: 533 - DNA, 369 bp, Nicotiana tabacum
gttatttgggcattagcagaaatgataaagaatccaagtgtaatggcgaaagcacaagcagaagtgagagaagcttttaaaggaaagaaaacatgtgatgaggatactgatcttgaaaagcttagttacctaaatttagtgatcaaagagacactccgattacaccctccaactcctctacttgtcccgcgagaatgcagggaggaaacagagattgaaggattcactataccgttgaaaagcaaagtcttggttaacgtatgggcaattggaagagatcccgagaattggggaaatcctgaatgttttataccagagagattcgaaaatagttctattgagtttactggaaatcattttcaacttctt

SEQ ID NO: 534 - protein, 123 aa, Nicotiana tabacum
VIWALAEMIKNPSVMAKAQAEVREAFKGKKTCDEDTDLEKLSYLNLVIKETLRLHPPTPLLVPRECREETEIEGFTIPLKSKVLVNVWAIGRDPENWGNPECFIPERFENSSIEFTGNHFQLL

SEQ ID NO: 535 - DNA, 462 bp, Nicotiana tabacum
gaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccc

SEQ ID NO: 536 - protein, 93 aa, Nicotiana tabacum
RWVEESDIKDLVYLQAIVKEVLRLYPPGPLLVPHENVEDCVVSGYHIPKGTRLFANVMKLQRDPKLWSDPDTFDPERFIATDIDFRGQYYKYI

SEQ ID NO: 537 - DNA, 417 bp, Nicotiana tabacum
cttatggtggatttattcattgctggaagtgacacatctgctataacaacagaatgggcaatggcagaacttcttcgaaaacctcaagtacttaacaaagtaagagaagaaatacttcaacaaataggcacagaaagaccagtgaaagaatcagacattgagaaacttccataccttcaagcagttgtaaaagaagcaatgagacttcatccggcagtttcattactcttgccacacaaagcccaaaatgatatacaagtgttgggctacactgtgcctaagaacactcaagttctcgtgaatgcttgggcaattggaagagatccaaaatcctgggataagccactggagtttatgcctgaaagattcataaagtctagtgtggattacaaaggtagggactttgagtttataccc

SEQ ID NO: 538 - protein, 139 aa, Nicotiana tabacum
LMVDLFIAGSDTSAITTEWAMAELLRKPQVLNKVREEILQQIGTERPVKESDIEKLPYLQAVVKEAMRLHPAVSLLLPHKAQNDIQVLGYTVPKNTQVLVNAWAIGRDPKSWDKPLEFMPERFIKSSVDYKGRDFEFIP

SEQ ID NO: 539 - DNA, 501 bp, Nicotiana tabacum
cacatgaaaatgtaaaggattgtgttgttagtggatatcacattcctaaagggactagattattcgcaaacgtcatgaaactgcagcgcgatcctaaactcttgtcaaatcctgataagttcgatccagagagattcatcgctggtgatattgacttccgtggtcaccactatgagtttatcccatttggttctggaagacgatcttgtccggggatgacttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggtacctgagctttactaaaacctaagatctttcatcttggttgatcattggttaatactcctagatgggtattcatttaccttttttcaattaattgcatgtccagcttttttaatttggtatattt

SEQ ID NO: 540 - protein, 129 aa, Nicotiana tabacum
HENVKDCVVSGYHIPKGTRLFANVMKLQRDPKLLSNPDKFDPERFIAGDIDFRGHHYEFIPFGSGRRSCPGMTYALQVEHLTMAHLIQGFNYKTPNDEALDMKEGAGITIRKVNPVELIITPRLVPELY

SEQ ID NO: 541 - DNA, 304 bp, Nicotiana tabacum
tataagtatatcccgtttggttctggaagacgatcttgtccagggatgacttatgcattgcaagtggaacacttaacaatggcacatttgatccaaggtttcaattacagaactccaaatgacgagcccttgggtatgaaggaaggtgcaggcataactatacgtaaggtaaatcctgtggaactgataatagcgcctcgcctggcacctgagctttattaaaacctaagatctttcatcttggttgatcattgtataatactcctaaatggatattcatttaccttttatcaattaattgtca

SEQ ID NO: 542 - protein, 73 aa, Nicotiana tabacum
YKYIPFGSGRRSCPGMTYALQVEHLTMAHLIQGFNYRTPNDEPLGMKEGAGITIRKVNPVELIIAPRLAPELY

SEQ ID NO: 543 - DNA, 403 bp, Nicotiana tabacum
ttttaaagatatagattctgtttttcagaattggttagaggaacgtattaataaaagagaaaaaatggaggttaatgcagaagggaatgaacaagatttcattgatgtggtgctttcaaaaatgagtaatgaatatcttggtgaaggttactctcgtgatactgttattaaagcaacggtgtttagtttggtcttggatgcagcagacacagttgctcttcacataaattggggaatggcattattgataaacaatcaaaatgccttgatgaaagcacaagaagagatagacacaaaagttggtaaggatagatgggtagaagagagtgatattaaggatttagtatacctccaagctattgttaaaaaggtgttacgattatatccaccaggacctttgtta

SEQ ID NO: 544 - protein, 134 aa, Nicotiana tabacum
FKDIDSVFQNWLEERINKREKMEVNAEGNEQDFIDVVLSKMSNEYLGEGYSRDTVIKATVFSLVLDAADTVALHINWGMALLINNQNALMKAQEEIDTKVGKDRWVEESDIKDLVYLQAIVKKVLRLYPPGPLL

SEQ ID NO: 545 - DNA, 304 bp, Nicotiana tabacum
tataagtatatcccgtttggttctggaagacgatcttgtccagggatgacttatgcattgcaagtggaacacttaacaatggcacatttgatccaaggtttcgattacagaactccaaatgacgagcccttggatatgaaggaaggtgcaggcataactatacgtaaggtaaatcctgtggaactgataatagcgcctcgcctggcacctgagctttattaaaacctaagatctttcatcttggttgatcattgtataatactcctaaatggatattcatttaccttttatcaattaattgtca

SEQ ID NO: 546 - protein, 73 aa, Nicotiana tabacum
YKYIPFGSGRRSCPGMTYALQVEHLTMAHLIQGFDYRTPNDEPLDMKEGAGITIRKVNPVELIIAPRLAPELY

SEQ ID NO: 547 - DNA, 344 bp, Nicotiana tabacum
gagattcattgctactgatattgactttcgtggtcagtactataagtatatcccgtttggttctggaaggcgatcttgtccagggatgacttatgcattgcaagtggaacacttaacaatggcacatttgatccaaggtttcaattacagaactccaaatgacgagcccttggatatgaaggaaggtgcaggcataactatacgtaatgtaaatcctgtggaactgataatagcgcctcgcctggcacctgagctttattaaaacctaagatctttcatcttggttgatcattgtataatactcctaaatggatattcatttaccttttatcaattaattgtca

SEQ ID NO: 548 - protein, 86 aa, Nicotiana tabacum
RFIATDIDFRGQYYKYIPFGSGRRSCPGMTYALQVEHLTMAHLIQGFNYRTPNDEPLDMKEGAGITIRNVNPVELIIAPRLAPELY

SEQ ID NO: 549 - DNA, 417 bp, Nicotiana tabacum
  modified_base (273)..(273): a, c, g or t
  modified_base (275)..(275): a, c, g or t
  modified_base (294)..(294): a, c, g or t
  modified_base (300)..(300): a, c, g or t
  modified_base (374)..(374): a, c, g or t
  modified_base (386)..(386): a, c, g or t
cagtgaggaagatgatgaggatgtagttgaacaacgttggaatggatatatgggaggccgttgtaagaagttcaaagctaacgattttgttacagagaaggcgaagaataaaaaagacgaggataggctcttctgggaaacttgtttagcttcttagcttaaatctcataagggaagccctgccgtagctggtaaagttgttgtcatatgaccagaaggtcacgggttcgagccgtgtaaataggctcttgcagaaatatagggtaaggctgngnacaatagacctttatgatntggctnttcctcggaccccgtacatagtgggagcttagtgcaccgggctgccccttcttgtggtaattagttggtaaatntctcacgttttnttaagaaccgtcagacattttccattgccaa

SEQ ID NO: 550 - DNA, 343 bp, Nicotiana tabacum
atattgagcgactggaaattactggtgttggtgatccatccggtcggggattagggttcagttacgtccgcaccactcctaaggcaccaatatcaaatgcaatctccaagaaaaaagcagttgttgctaaagggtcaacagtaacaggcactgatgcagatctaagaagactgagcatggaagctgcacgcgaggttcttctcaagtttaatgttccagaggagcagattgctaaactaacaaggtggcaccgaattgctatgattcgcaagctctccagcgagcaagctgcatcaggtgtcaaagttgatctgcaacgataagcaaatatgcacgtgggcag

SEQ ID NO: 551 - DNA, 384 bp, Nicotiana tabacum
gatggagaagaaccaattgaatagtcgaaaaatgaatgtcggaatgtcgccgccggcgagcgaggtggacgtgaagccagagattctgccgttgccgatctcgacaaggccgtcgcaggtttacagtgactttatatacttcgattcatcagattctctgccgaagcttcacactgattccagctgctcggagcaggtgctgtcgtcggagttcacgtgtgagagagaagttcagagcgagccgaaattgagcgattgggagaaaactgccctggaccttcaatttaattacatggatgccatcccggacgtcggagataacggcttgctaggttctcagttccagggctgttatgaaatgtcgccgcttcaggatatattcat

SEQ ID NO: 552 - DNA, 564 bp, Nicotiana tabacum
  modified_base (389)..(389): a, c, g or t
gacatgtcctatgaggaattattagctcttgaggagaggattgtctctgttagtacagctctgcccgaggaagcactatcaaagtgcctccggaaaagcatttatcagggtatggattcaaaaacagaaacatatgaagctgatggggatggagatgacatcaagtgcagtatttgtcaggaggagtatgtgattggagatgaaatagggaagtttggatgtgagcacgggtatcatttggagtgcataacacagtggtttaggctcaagaactggtgcccgatctgtaaggctacagcagctccgtcagagtcgtcgaaaaagccatcttagtttcagaattttagatatccaacctagatttgggaagctgaaaaacttccccgtgnacaaattcatctggggttggtttgtggattcctgcaattcatttttcctgttctctttttctctattcttgaacttttttcttaattgctcttgccatatgaaccaataaacccaggccattttctggctttgtggtgaatgctttcatattcatttctttaaagcttttctgaa

SEQ ID NO: 553 - DNA, 490 bp, Nicotiana tabacum
ctactacggtcgaggacccatccaactatcatggaacttcaactatggacctgccggaaaatccataggattcgatggcttaaatgaccctgacattgtggctagagatgctgttatttccttcaagactgccctgtggtattggatgaacaattgccattctctcattacttctggccaaggttttggcccaaccattcgagccattaatggccagattgaatgtgacggaggcaaccctcagactgttgccagaagggttgagtattatactgagtattgtcaacaactgggtgtggagactggggataatctcacatgttaggacgtaagtaattaaagaagttgaattaaagaataaccaaagatattaattattagttgctccacggtagtgaggctgcatatatatgttctgagaattgaataagactccactatacatgatttattttaaaaagaatatacgattatattacaccaaaaaaaa

SEQ ID NO: 554 - DNA, 362 bp, Nicotiana tabacum
caaaaaggatcccggccatagcagcggagagcacaaggaagggattgttgagaagataaaggaaaagatccatggagaagaaggcggagagcaccatcccaaggaaggagaggagaagaagaagaaaaaggacaaaaaggacaaaaaggagaagaagcacgatgggcatgacagcagcagcagcgacagcgatagcgattagatctaatcctcgatccctaaataatgatccttccttattagcctttctccaatgtatttcctactgctttctgatatagatctatcttccttaccacttagcagttgcttgtatgttttattggaatgtaattaacgtttgaatcgcttgctgtagaaaa

SEQ ID NO: 555 - DNA, 286 bp, Nicotiana tabacum
  modified_base (186)..(186): a, c, g or t
  modified_base (217)..(217): a, c, g or t
gctttgactacagaaccatgcctgtctgttggagcgaattggatgatcgggccgagggctgccccctcttcccctcactctcctttccctaatatgaaccttgagtcatcaaagcctttccgactcggcctggcccggtcgccctacgcgactggcgcttcaaaaggcgaaactctcggtcgtagnttggcgacctatcttcagtaggggcctttantcttttgattagagcaggggtcgcgagagagcagagcgtacctgcccgggcggccgctcgaaatcacta

SEQ ID NO: 556 - DNA, 571 bp, Nicotiana tabacum
  modified_base (544)..(544): a, c, g or t
  modified_base (566)..(566): a, c, g or t
tcttgaggtcatagatgctggaaaaaagaaactctacgaggctaaggtctgggtcaaaccatggttgaatttcaaggaacttcaagagttcactcatgttgaagatgttcctaccttgacttcttcagatctaggtgttaagcaagaagatgaaggctctggattgaaatcagtgcctgtgcatgatccggtggttcaggaagctgcagagcatgcaattaagaccatccagcagagatccaactcactacttccatatgaactccaagagattgttcatgcaaatgctgaggtcattgaggaggacaatatgaagcttcatatgctcatcaaaactagcaggggagggaagcaagaaaagttcaaagttcaagtgcaccacaataaagaaggtgccttccaactgaatcatatggagcctgaccactcctaaactgttgaactagctctggacgtcgtttacctctttaaagttttaagaaatgttcccactatggaactatgggagatacataatctatcttttgaagtaaataagcatgtnaccagcaccaatttatatattnctgct

SEQ ID NO: 557 - DNA, 388 bp, Nicotiana tabacum
tgccatgaagtcactaggcagaggtagcatggatgacatcaagtatgtcggtcgtgctccttctgccgccacagccactgggttctaccaagttcatgtgaaagagcagtctgagcttgtgcagaaagccttgcagcgtgatcccgttaacaatccgttctgaagctgaagcgttcacgtatccatatagcactagcctccaaaactgatgcgacaatagaatgtttacttttctctgtgcctggtaatgagagtttcagttgtttggaaataaggccgttttgtttgtgcttcttttcagctggttaaacaattttactgatgctttcacatgtatacgttttcagttagtaacaattttgatcagtaaactcacggctccatcgca

SEQ ID NO: 558 - DNA, 424 bp, Nicotiana tabacum
tatattatgcccttccgcatcctatgaactataatataacagccttcgctcagcaacttacttttgttttcagatgagtatgtcatctgcaatggatgtaaaagtccagatactatcctttctaaggagaaccgtctattcttcctcagatgcgagaagtgtggttctggaagatcagttgctcctatcaaggctgggttcgttgctcgtgttggcaggcggaaagctgggacttaagacggcttggggatttttagttggacaatttcatcttataatcaactttgttaaaagttttgtatgttatgctttgtgtttaaccgagatattgacatgtggtgcaactttgcttatgaagagagttgatatagattcagttttgtgtgatgttgtcttttgcaattcgtcacgctacacgtttcga

SEQ ID NO: 559 - DNA, 554 bp, Nicotiana tabacum
aagaatacgacatcgtagtaaagaaacaagatataagtttcaatggagtttattacgtcaaagaggcgatgaaagaaatcgttaggagttactacattgaagcacaatggttcatcaaagggaaaagtccaccatttgaagaatacctaagtaatgcactcatcactggaacttattacctacttgctccagcttcattattgggcatgaaatcagcttcaaaggcatcattcgattggatgatgaataaacctaaaattcttgtggcttctgcattaattggtcgagtcattgatgacgttgcaacttacaagattgagaaagaaaaaggacaacttgtgacgggaatagaatgctatatgaaagagcacaatttaacagtggaagaagcaagtgcacaacttactgaaattgctgaaaatgcgtggaaggatttgaacaaagaatgcattaagccaacttcaatgccagttgaaatcttgaagccaatcgtaaatctaacacgtctaattgatgtggtttaccaagaataatggaagatggatatagtaatc

SEQ ID NO: 560 - DNA, 439 bp, Nicotiana tabacum
tgctgggggcctagctgttctcagagtaattgaaaaagagaagcttcagcaaaatgcattcagtgtcggatcatatcttaaaaaccggcttacttctctaatggagaaacatgaaataattggtgatgtgaggggaagaggtctgatgcttggcgttgagctggttactgatagacagtcaaaaactccagctaaggtggaaatattgcgagtaatggagcagatgaaagaaatgggagtcctcattggaaaaggaggattttatggcaatgtttttagggttactcctcctctctgcttcaccaaggaagatgcagattttctcgttgatgtgatggattactcaatgtcaaagatgtgagtcaagaagctggttatgcaattaccggtgtttgatcgaaacttgctagaatatttaatatgaagtggcgttaggtgt

SEQ ID NO: 561 - DNA, 272 bp, Nicotiana tabacum
aggttacggtgtaattccaacatcattaacggtggaattgaatgtggcataggacggaatgacgcagtggaagatctaattggatactacaggaggtattgtggtatgttaaatgttgctccgggggaaaacttggactgttacaaccaaaggaacttcggccagggctaggcttcgttacatagaatgcagatcatgttatgtatacaagttatatttgtattaattaatgaataaggggattgtgtatccattaaaaaaaaaaaaaaaaa

SEQ ID NO: 562 - DNA, 430 bp, Nicotiana tabacum
gtattgggttccttgacttcggaattgttggtcgtatatctccaaagacatgggctgcaatggaagtatttctgcaatctataacaattgaagattatgagtcgatggcatctgctctaattgacatgggtgctaccgggaaggatgtggattcaaaggcttttgcgagtgacttggagaaaatatttttgtcaattcaggatttggatacagaaatcattgttgctgctgcaagggacacaaatacaaatgcaaccgctgttgctgccaatgtagtatttgatgagaggcagatgaatgctctattcgtggatgtggttagagttagtgaatcttacggattgaaatttcctcgtgagtttgcacttttgttgaagcaacttctctattttgatcgatacaccagattgttagctccaaatatgaacat

SEQ ID NO: 563 - DNA, 413 bp, Nicotiana tabacum
cataggaatgatgatgatgaaccagtaaggtctgatcaggttcagattacctcgttgattggttcaggatgcagcagcgttgcaggcagtcatgaactaagaaaaatccttgtggatccttagctctctctttgaaactgaactcttaaacaggcatgtatatgtatagtcaggtgatagttatatctattgttacgccattatatcctggtcctttattatcttggactgcgcctagtaagacctccgtttgtaatagtttgatctattctggcttgttttgaagtagattagtactataaattttgagaagccagaggctttgatgtctttataatctctgttgctggtttaggttgcactttgtgtggctcacatgtttatagaaatgtagcatttctggcctaaaaaaa

SEQ ID NO: 564 - DNA, 451 bp, Nicotiana tabacum
tagcaaccttgctcggctatgtagctacttctcgggatccaattattgggggcagcttgctattgacatacacaactggctatgttactcccttactacttgctgcctcttttgctggagcattgcagagtatactttcattccgcaagttctcagcatggatcaatccagtcagtggtgcgctactattaggtgggggtgtctatacctttctcgacaagctttttccagtgacaatggctatgtaggctaatcagctattcaaatagcaacagctggaatggggatgagctttacctgcttcttcttactgtttgagttgcttatgctcaggcaaagcatcattgagttacatagagcaaagtttcaaatgaatgagcaagcaaaggtacgatgtatatgtgggatctgtaactttaactcctacaacaagttgtagaaggtagaaaat

SEQ ID NO: 565 - DNA, 488 bp, Nicotiana tabacum
tgcctcctgctgttggtgaagtgcaggctttcagaatttcaggtccaaagtttgtaaagctgaaccatggtacatggcatgctgggccattatttacagatgacaaaatggacttttacaatctggagctgaacaatactaatgtggttgatcacacaacacatgacttcatcaagaagaatggggtggttttcctactggatgattaggaaaatcacaccaagcaaagcatttcgagtttcgaatgaatgataggctggggggatagtcatgcagttcatgctgtttagagcacttctaatatataccttacatatgtaccataagtaagggctgactagcattgctttctggcttttgcttgtgctgtgaacaactgtaaatagtagcatttatttatcttacactcggctacaagcctacaacactatgccctggtattggtctgtatttgtaaatgcagctcaagtaaaactctttgattttaa

SEQ ID NO: 566 - DNA, 357 bp, Nicotiana tabacum
aggaacctaatgaggaatgataaatccctgaaagactctgttaatcaacaaccaaaataccgacctcctgtaaggaatgtcccaatggttggttctggagtgacaactcgtgccatttcggatgcagctgagaagctggcgaacgtgagcattggctctggtagaggacctacaaagcagccagtatttaagccaatgaaggcaggagggtggcatgggcatcaggacttgttccatggacggtctcaagagtttcttcctggaagaagctattcaaggaaagttgctggatgaagaatgttataagcttgagtgtcgtattctgttcaagtgttatttagtgatagtagtctttat

SEQ ID NO: 567 - DNA, 325 bp, Nicotiana tabacum
caaggagatggtaagtgagggaggcgtagcagagggggaagttgttgtttggctggtgatgaaagaagatctacggctgccggaaagcaaaaacacggcggcgttcacgtgccgggttagggttatcaaaagcgggaaggagaaaaactcaccgattctgccgtgtgatgtgtggagaatggacggcggaggatatgcatggaggttggatacaaaggcagctctctctttgggccggtaggtaaaagtaatatcaactcaacctaaagggtaaaagagtaaatctatgcgccatccaacaatacagttgccaacttgcgcttga

SEQ ID NO: 568 - DNA, 593 bp, Nicotiana tabacum
  modified_base (545)..(545): a, c, g or t
  modified_base (560)..(560): a, c, g or t
caaacaagttcttccagctttggctcaagttgcagaacgccagggaaaatatctggcaggtctgttgaaccggttgggtaaagaaggtggagggcatgctaattctgcaaaggacatgaacctcggagatccatttatgtataaacacttagggagcatggctactgttggcagatataaggcccttgtggaccttagagagagcaaggcgggaaaaggtctctctttggctggattcacgagttggttaatttggcgttcagcatatctaactcgtgttgtaagctggcggaacagattctatgtagcaatcaactggttgacaacttttatctttggccgtgatataagtcggatatgaacttttaccaaaacttccttcagtttggctcagcatggtaaactatgtggtattgaatgtgttacttctcctccaagttgatttcttgaataagttagctattatcaacttcttaagtaagattgcggtatgacttgcagaaattcgatataggttctgatctagcctattattggtaatagtngaaggatgcctaatnagaagggagttcatgctttggaaaaaaatgctg

SEQ ID NO: 569 - DNA, 517 bp, Nicotiana tabacum
tatggatatggtcaggactatcaaggagcaaaaccgaaagaaacagaagacttttagtgatcgtgctgcagttgaagagaaaggcaagcctagaaaggccgtgttcgagggccgtggtagaaaagcatgagtttgggatggtaaacaggaagtggaaggcagtggttgatggttgtaactaagctctcaatcgggcgtttgcattgcaatgttgctgccctgttgttggagatggttttggattggaagtttctgtggcagttaagttgttttgcctatggttttgaaattttacctttcccatatcaggacgatttatgtcaacttagtcctagtggatttgtagctatgttaatgcactttcttgcttatgcaatctagtttagggaaatatttcctgcgaattaaacgttgctatgcattaggttcagctgttcagtacatatgagagtttctataaaatgtatgctctagaattacctataaaaaaaaaaaaaaaaaaaaaaaaaaaaagctt

SEQ ID NO: 570 - DNA, 375 bp, Nicotiana tabacum
gaaatgcaattagacaagacctagttaacaacccagatttagtagctacagatgctactatatcattcaaaacagctatatggttctggatgacaccacaggataataagccatcaagccacgacgttatcatcggtagttggactccgtccgccgctgatcagtcggcgaatcgagcacctggttacggtgtaattaccaacattattaacggtggaattgaatgtggcgtaggtccgaatgccgcagtggaagatcgaattggatactacaggaggtattgtggtgtgttgaatgttgctcctggggacaacttggactgttacaaccaaaggaacttcgcccaaggctaggattcgttagatcatgttatgt

SEQ ID NO: 571 - DNA, 603 bp, Nicotiana tabacum
ccaattatctatggtgatgtgagccgccccaacccaatgactgtattctggtcaacaacagctcagagcatgaccaagcgcccaatgaagggaatgcttaccggaccagttaccattctcaactggtcttttgtcagaaatgatcagccaagatttgaaacttgctaccagattgctttggccattaaggatgaagtggaagatttggagaaggcaggcatcactgttatccaaattgatgaagcggctttgagagaggggttgcctctaaggaaggctgagcacgccttttacttgaactgggctgtccactccttcagaatcaccaacgtaggcattcaagacaccacccagatccacacacacatgtgctactccaacttcaatgacattatccactctatcattaacatggatgctgatgtgatcacaattgagaactcacgatccgatgagaagcttctctcagtttccagggagggggtgaagtatggtgctggaattggccccggtgtctatgacatccactcccctagaataccatcaacggaggagattgctgacagagttaacaagatgctggctgttcttgacaccaacatc

SEQ ID NO: 572 - DNA, 459 bp, Nicotiana tabacum
cgactttgcaccttgtgcttcgtcttcgtggtgggatgcagatttttgtgaagacgttaaccgggaaaaccatcactttgggggtggaaagttctgatactattgacaatgtgaaagctaagattcaggacaaggagggtatcccccggatcagcagaggctgatctttgcgggaaagcaattggaagatggacgaaccctcgctgattacaacattcagaaggagtccaccccgcaccttgtcctccgtctccgtggtggtttctaaagtgtctgtcagtgcctgtgtctgtgtctggggtctgtttggttcatgatttagaatttgtgtagtttctgttagttgtcatcatgttatgtttccaaaagaggcgaggaggcttgttccctcttgtctctgtttgtgaataataaagtttaattattgtttaaaaaaaaaaaaaaaaaaaaaaaaaaaaa

SEQ ID NO: 573 - DNA, 391 bp, Nicotiana tabacum
cacaacttttccaacttcaatatctttattcactaatactctatatttcttgattccttatctccctcttctcactctctctctctctctctctctctctctctctctctctctctctatacataaaagaaaaactccattcattcgcagctagctttgatcagtagagtttgtggctgaagttaaaagaagatgagaagaaactgtaacttggagctcaggcttatgcctccttctttttccttttctcctaagaattgcactaccccctacttctcaatggatagggaggaaaaaagaaagcacagaagagacagcaactgcgccaccgtttgtctgaccgaaggattttctggtggcgactgccgtggattccgccgccgttgtttct

SEQ ID NO: 574 - DNA, 620 bp, Nicotiana tabacum
acttctatgaccagcacagaggtatgagattagatatcgatgacatgtcctatgaggaattattagctcttgaggagaggattgtctctgtcagtacagctctgcccgaggaagcactatcaaagtgcctccggaaaagcatttatcagggtatggattcaaaaacagaaacatatgaagctgatggggatggagatgacatcaagtgcagtatttgtcaggaggagtatgtgattggagatgaaatagggaagtttggatgtgagcacgggtatcatttggagtgcataacacagtggtttaggctcaagaactggtgcccgatctgtaaggctacagcagctccgtcagagtcgtcgaaaaagccatcttagtttcagaattttagatatccaacctagatttgggaagctgaaaaacttccccgtgtacaaattcatctggggttggtttgtggattcccgcaattcatttttcctgttctctttttctctattcttgaacttttttcttaattgctcttgccatatgaaccaataacccaggccattttccggctttgtggtgaatgctttcatattcatttctttaaagcttttctgaaaaaaaaaaaaaaaaaa

SEQ ID NO: 575 - DNA, 484 bp, Nicotiana tabacum
cttattacattgacttagttggacgatacaaattgagctcgcatgcccgcacaaaaactgatggagcaagaacgaaggttgctcaagagatttacaaagaactgcagaatgccaggcaagaagcgctgcagagaaagaaggctgagcagagaaagaagatagaggaagctgaggctaagcttagtgcagaagctcttcgcaagaaagaggctaaagagcgtgcacggcagatgaagaaggcaatgccaaaaatgaaaatgacccgggctgggtagattcgagtttatgtgccatctcaatcttctctagatcccgtcaatggtcattgtgtgtcccagtgtcgctgaatttgattcttgtattaggtagacgggatgtctctttgttggttctgtaatttagttaagtagtctaggggtctttccttattctggccacaggttgtggattttgacttagtttggtgcctattgtgaagtaatgg

SEQ ID NO: 576 - DNA, 325 bp, Nicotiana tabacum
aaacacaggcaactttatcacggaccgaccatctaccaaagtccatgctgctcctggaggtggatcttctttgggatatctcttcggggatggcagcagctaagcaattccccaatctacagttggataattgtcttattgtttctttaccttttgtctttcgactatgttgtaattgtaattgcgagtatttcaggttgttgtgaagtgttaattggataaacttccatctaaagtcccagttgacactttgaaactaaagttactactatctaatgtaatatgtgacttttgttgattgaaaaaaaaaaaaaaaaaaaaaaaa

SEQ ID NO: 577 - DNA, 359 bp, Nicotiana tabacum
ttttgtgaaaaaggggactagagtaagttatcatatctatgcaatggggagagtggggaacttatggggaaaagattgggcagagtttaggccagagaggtggttagataaggatgaagcgtcaggtaattggacttttgtggctagggacacctatacttatcctgtttttcaggcgggaccaagaatttgtttaggaaaagaaatggcatttttgcagatgaagagggtggtggctggtgttttacggcggttcaaggcggttccgctggcagaaaaaggtgttgagccggtctttttgtcttacctcactgcgaaaatgaaaggtggtttccctgtgacaattgaggaaaggaacg

SEQ ID NO: 578 - DNA, 417 bp, Nicotiana tabacum
attgaagagtaatggtggattatttttttggatggatttgagaagattacttaaagagtcaacatttgaagctgaattggatctttggcatataattataaatgaagttaaactcaatgtttcacctggtgtttcatttcattgttctgagcctggttggtttagagtttgttttgctaatatggatgatgaaactatgagagttgcattgagaagaattagacattttgtgctacaaagaaagggattaattgaagttgctaccaagcaacaatgtagaaggagcaaacttgaaattagtttatcatttagaagattggatgatttcatgaactctcctttcatgaattctcctcactctccaatgtcttctcctatggtccaggcgaggacttaatggcgtccagatcagcttgc

SEQ ID NO: 579 - DNA, 271 bp, Nicotiana tabacum
gctctgctctctcgcgacccctactctaatcaaaagactaaaggcccctactgaagataggtcgccaaactacgaccgagagtttcgccttttgaagcgccagtcgcgtagggcgaccgggccaggccgagtcggaaaggctttgatgactcaaggttcatattagggaaaggagagtgaggggaagagggggcagccctcggcccgatcatccaattcgctccaacagacaggcatggttctgtagtcaaagcaacttcgtcactttcgt

SEQ ID NO: 580 - DNA, 511 bp, Nicotiana tabacum
  modified_base (26)..(26): a, c, g or t
  modified_base (399)..(399): a, c, g or t
  modified_base (474)..(474): a, c, g or t
aacccaagctacggagcaagaccgtngaggagagctattatgatactgctggaagacagcatggctgagaagatgcttgcaggtgagatcaaagaaggtgattcagtaattgtggacgtggactctgatggcaatgtgaccgtcctcaatggcactagcggaactccctcagatccagctcctgagcctatccctgtgtagatccgcttcttgctttagctctgcaaattcgttgtttgtaatgttgctttcatttgtcttggccactaagctctcctggggttatgaagcaacttgtgagtaatttatggggtcattgggtgaaatctgccaagttgagaagggtggcatctccattatatgcagagctttacaggattacacactacatactggatntcgtgaagattgtagtgacctcgcaagatagtgtaaaattgcgacgaagactatgtagaaccatatcttctaatntatggtaggtgatagtcgaatttgtcataaaaaaaaa

SEQ ID NO: 581 - DNA, 519 bp, Nicotiana tabacum
ttgattctccctctagaaagaaaaccctcggcggaagaacagtagtagaagcgtgatcatcatgtcggctagcggcggcggtagtggtggcgcaggagaggaagggaagaagcctaacgatcaggcggttcatatcaatctgaaggttaagggtcaggatggaaatgaagtgtttttcaggatcaagcgtaacacacagttgcgcaagctcatgaatgcttactgtgaccgtcagtcggttgacatgaactcaattgcattcttatttgatggtcgcaggcttaagggagagcaaactcctgatgagctggagatggaggagggtgatgaaatcgatgcaatgctacatcaaactggaggcaatgatgcatgatgctgctgcgcttttgttcctaattgttaacttggtggttatatggttgtagttggttgttagggtgaacgctttggagtgttggttattactctcccatctgcctaaatgggggagtgtatggatgttagtagttttagttttca

SEQ ID NO: 582 - DNA, 216 bp, Nicotiana tabacum
ccaattatctatggtgatgtgagccgccccaacccaatgactgtattctggtcaacaacagctcagagcatgaccaagcgcccaatgaagggaatgcttaccggaccagttaccattctcaactggtcttttgtcagaaatgatcagccaagatttgaaacttgctaccagattgctttggccattaaggatgaagtggaagatttggagaaggca

SEQ ID NO: 583 - DNA, 142 bp, Nicotiana tabacum
gagcacctaaataatccgtgtgtgtgtgtgagtcttccctttgatgtaagggttttacttctatatcttggtggggtttaattatgtcatgcacatgttgttcactgtgcaagtgtgaataatactataccttttaatgaaa

SEQ ID NO: 584 - DNA, 265 bp, Nicotiana tabacum
tgtttggactgtatgaatggcgctctctgctctctttgtttatctcatcacaaggaacatcgtgccattcagataaggaggtcatcttaccatgatgtgataagggtgaatgaaatacagaagtatttggacatcacttcagttcagacctacattatcaacagtgcaaaggttgtgctcttgaatgagaggccacaacctaggccaggcaaaggtgtcactaatacctgtcaggtttgtgaaaggagtctcctcgactccttca

SEQ ID NO: 585 - DNA, 272 bp, Nicotiana tabacum
atgaagctcaatacggtggtggaggataccctgccggataccctgccgccagataccccgttcctggtggcggatatcctgatggaggccgtggtggtggtgtctatcctggcagtggacgtggatgcggaggatactgccgctatggttgctgcggccgccggaattacaggtgctgctcctacaaaggtgaggccatccatggataaggtcactatattgaggctaagcctcacaacgtatcatcatgtggagcaatatataaaaccttt

SEQ ID NO: 586 - DNA, 251 bp, Nicotiana tabacum
acagcttacattcggactgggccattcatggaggatgcaactgactcaaaaataagcttgactctctacgatgcgagtggctatggaattagaatcaagaacctagtggcttggggtgggcttatgggctcaggttacaactactttgaaacggaccactcagatatgttcagtggccatggaccatgtttgactgggccgatctgcaaaatggtcttgacttctgatggtacaggccgacaatccgcgtg

SEQ ID NO: 587 - DNA, 592 bp, Nicotiana tabacum
attcttacttacatggctcgtggttcccctcattcagggttttgaagatgctggagattttacacttgtagagcgattgaagactagcatacatgccaacttggtcttctatgccatcctgggggtcgtcggtcttcttggacttattctcctcattaccatgcgaaaacgttgggatggtaatgcactgggttttgctatggcatgctcaaatacttttggacttgtgactggtgctttccttcttggttttggtatgagcgaaattccaaagagcatgtggaaaaatgcggattggactactcgtcagaaggtgctttctcataaaattaccaaaatggctgtgaagcttgatgatgcccatcaagaattatcaaatgctattgtggttgctcaggcaacatcgaagcagatgtccaagcgtgatcctttgaggccttatatggacgttattgataagatgttagttcaaatgttcagggaggatccatctttcaaaccgcaagggggtcgattgggagaagatgacatggattatgatacagatgagaaatcaatggcaaaacttaggcgtaatcttcgtatagctcga

SEQ ID NO: 588 - DNA, 540 bp, Nicotiana tabacum
accctgaaagctggaggtcttcaactggagaaagactatccttacactggcaaggatggcaaatgtcactttgacaagagcaaaattgctgcagctgtgactaacttcagtgctattggtcttgatgaagaccaaattgctgccaacctggttaaacatggtcctcttgcagtggggatcaacgctgcttggatgcagacatatgttggaggagtttcatgcccattaatttgcttcaagcgtcagggtcacggagtgctcttagtaggttatggttctcatggctttgctcctatcagactcaaggaaaaggcttactggatcatcaagaattcatggggagagaactggggagagcatggatattacaagatttgcaggggtcacaatatctgtggagttgatgccatggtctctactgtgactgctgcccatactactaatcctaacctgtgagatgaacttatcccaggaatgttgcctgtgatcaagggttttactacattatcctaatttgtgtaaatatgtcgttcagtaaat

SEQ ID NO: 589 - DNA, 409 bp, Nicotiana tabacum
tggctacactgcttatgcgcaacaaagacgcaaagaggcagaagagaagcgacctagtgacaagaagttagatagaagatcttgacaatctaattagattcactgactctgaaatattacggctgcagcacccaagcatagacatgaaagtaatgcctctaaagagattatggactcgggattatgatcatctttgctgtgtgtagacgagctttagagctttttatatttgtcttgccaacacaatcccgtcctgcaaaagtttgccagatgacaaaaaagttatcttccttcgagcagtggtgcctcatttagagaggcaatttactggcatctattgtaaattgcatacattgatacccagttcttttactttgtgaaattaatcatggattttgaagtcaggaat

SEQ ID NO: 590 - DNA, 528 bp, Nicotiana tabacum
aactgcaccaataccattcctgggcaattgttggaaaatgtctctgttattgtggatccgtccgaagctgaggaattttctgaaatagcatccaaacctctcaagtctcttccatatgatactccagggcagacatttgtggcttttgagagacctgaaggagtccctgctgttgggaaattctcgaacacactaagtttcattgttaaagaggttgatccaaccactggtgaggctgaagatgatggtgttgaagatgaataccaactagaagacctggaggttgtcgctgcagattacatgctgaaattgggagtctccaattttaggaatgcatgggagagcttgggaccagattgtgaacgcgtagatgaatatggtcttggcccaagggaaagcctgactgaagcagtaaatgcagtcatcaaccttcttggcatgcaaccttgcgagggcactgaggtagtcccaagcaactcaagatcgcacacatgtttattatctggtgtatacattggcagcgtaaag

SEQ ID NO: 591 - DNA, 416 bp, Nicotiana tabacum
aaaaattcttggcagcctcgccagctagcattttgaagcctgaggcatcaggtcttaagcgggttggaaatcttttaaacaagatgaggaccaagaagagaacgattgatagttgtgccatgctaaggaaattgtgggatgataatcctcgagaattgttttcagaaattttggattggtttcagcagggatttcatgaccattttgaagacctttgggcaaagatgcaacttgaagtatttttagacccaaaaaaacggctttccaagaaggtcaagatgagagaaaaggaacccatgaactttctatgattagggatattatatgcctttcagaatctaagctggatggagagatgcagaggtgggttgaggttactgatttggaagatgggatactgtttgtgggggataatt

SEQ ID NO: 592 - DNA, 403 bp, Nicotiana tabacum
caaaaaatatgcaatggacaattcaagtgtcctaaatggatgtcatctgatctaaaacgatttttatctcgacttcttgatacaaatcctataacaagaataacaatcgaagaaatcatcaaagatccttggttcaagaagggcttgaaacgcgttaaattttgcgaggtagatggtcagcctcagaaacatattcagaatttaaatttaacgagtccatccagctctgatgagcctagcaaggaaatagaagaggttaaggagggagaagacaagagttcttatttgaatgcttttgatattatctcattctctttaggattaaacctctcaggattgttaaacgatgaatgcaatccgttggaggattcagagcggttaatcgtggaagagtcggatgaga

SEQ ID NO: 593 - DNA, 353 bp, Nicotiana tabacum
cttccagaaacttccacgcgctaaaccctcaccctactgccatccacactctcatcaggcccatttccgtcactctacagtctacaaccgtcgctaacggcagacgtagatcgagtatcgccggcgtttcaaccatggccaacggcggagataacggcgttacgtttcagttaactccgtcgagcttgttaaagattcagaaaggtgatatcactcaatggtctgtagacggattctctgacgctattgtcaatcctgctaatgagcgaatgctgggtggtggtggtgccgatggagccatacaccgagctgccggtccagaattacgagatgcatgctacaaagtcccagag

SEQ ID NO: 594 - DNA, 311 bp, Nicotiana tabacum
aagccaaaaccagttctcccgcggaatgtaaccccaactagaccactgcagtctgctcctaaacctacttctgctcctcccccaagtagacctcctccaagggaatcagccatagatcttgaaaagctaaattcagcaagaaggcggcttcaggagaattaccaagaagctcaaaatgctaaaaagcaaaggacaatacaggtgatggatattcatgagattccaaaaccaaagaacggcttctttgccaagaataaaggcggctttcagggcaggcatcatcgctgattttgtcagaagcccgtttgtgt

SEQ ID NO: 595 - DNA, 348 bp, Nicotiana tabacum
gcgaactcacgtgccaatatcacaatcctctgttgctgatttaccaattgcgagacgaaattcacttacaagatttttggagaaaagaaaagatagaattacttcaactgcaccatatcagatttacaacaaaaaaatagcagattctaagactgaggaaaataaggcatggcttggattaggtgcaaaatttgttccagtgaaaactgagcagttcttttagttattttggtaatactactggtagacggggagccttggcgtagctggtaaagttattgctatgtgatcacgaagtcacgggtggtctggccctttctcggactccgcacatagcagaagcttagt

SEQ ID NO: 596 - DNA, 322 bp, Nicotiana tabacum
aagtatattcacatagaagagatgcttgggaatgtagctggcgcgaggcagatttttgagaggtggatgacatggatgccggaccagcaagggtggttaagttacattaagtttgagttgaggtataatgaggtggatagggcgagggcgattttcgagagattcgtgcagtgtcatccgaaagttagtgcatggattaggttcgcgaaatttgagtttaagaatggggaggtagcgagggcgaggaattgttacgagagggctgtggataagttggcggacgatgaggaagcagagcagttgtttgtggcgttcgcggagt

SEQ ID NO: 597 - DNA, 651 bp, Nicotiana tabacum
  modified_base (581)..(581): a, c, g or t
  modified_base (622)..(623): a, c, g or t
  modified_base (634)..(634): a, c, g or t
tggagagggaagcagcaggggtgctaggtctaacagacgtatcgatcggtccgaactggaaggatattcggaccggtgggttttcactattgcgccaccattcatttctagaggcgcatcaatgaaatcaccaaaagttggagctgaaactggtgagggttccacctctggaagtgtgaaaaacgccgtcaaattaccgtcgtttaaatgcttggaaccaaaaggtgatgaaacctctttgatgtctgctgactcggctcgacctccggtttagtaaatctttaatccggttcgaggtaaccgcttttggagacgcgtctggcgacttttcgtgtgctatgaaagaggaccgtctttctcatgatgggttgggccccaccttgcaaggtataaatgtataatagtccaaagttaactttcaattttacaggtttagtagaaaaacatttttgttacttcgagcggccgcccgggcaggtactcttaagtcttaagtaaggtctcactgcttttctctatcctttgttcatttgctccaccttcttaaagcaacgcacagttggatgatgaattcaattgtntaatcaaatgcctcctattactgctgtcaactacaatagtnngatttacattnacgcctgctttgaactg

SEQ ID NO: 598 - DNA, 634 bp, Nicotiana tabacum
atcagagaaactatttacgaaactccatttcttcttcttctttagtgtgtattgtatggccgccaatttgcagagccgtggactcgtgagcttagggaaacgagttgtgaaccagatcagctacgctagtggtcgaacttctgctaactcaccttcactctctggcaggaggggagtgcagacatcggtttacgacaagaacccggaggatcatgtgcgggattcagtggtgccggatgaagtgatagagccacaatcagaaaaatactggggtcctcacccacaagctggggtgtttgggcctgcagccactgatagtgctggtggggaacgtggtttccactcctcacctgccactgctgctgctgctgaaaccattttggagcagaaggccttcttccgccctctagaggacttggacaaaccccagcacgcctaagtttcacattcccttaatagctccagtgcgtctatcctcactggcaaacttaagtctatatatagtgtgtagtggtggcttttaataagtttctgttttgcttgtgtttatgcgagtctgtattatatcaagtttaaagtgcagtatagactattagggtaaagctgcaccgcttttgaaggttccgttcatatg

SEQ ID NO: 599 - DNA, 536 bp, Nicotiana tabacum
cacctgcgttatcttttaacagatgtgccgccccagccaaactccccacctgacaatgtcttccgcccggatcggcctgcaagcaagccttgggtccaaaaagaggggcagtgccccgcttccgattcacggaataagtaaaataacgttaaaagtagtggtatttcactttcgcctttcggctcccacttatactacacctctcaagtcatttcacaaagtcggactagagtcaagctcaacagggtcttctttccccgctgattctgccaagcccgttcccttggctgtggtttcgctggatagtagacagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtaaacatccgcagggaccatcgcaatgctttgttttaattaaacagtcggattccccttgtcc

SEQ ID NO: 600 - DNA, 313 bp, Nicotiana tabacum
aacagaaatgaaaagggtaacccctaatggcagcccattgaatgataccaagtgttggcagctaacaaatagcatcaggaattactgagacaacagacagcccagaaaacttcccctaacggatcttcacaatacattttcaggtttctttaccctaactataaggaaaagagaccctacatgacttcaccaaaaacaagaagttggctgcatttgtctcctgacttctattataggttcttttgctttgtcaaatttatttattcctacttttgaacattcttaaatggaagctacttgttggagcacctgt

SEQ ID NO: 601 - DNA, 383 bp, Nicotiana tabacum
tttctccttctcttgtgcgtttttgttaagcaagttcttcagagggagaaacagagaaaaattctctacgataatgttggttatcaggatcttctctccggtgatgagctcctttcggattcattttcctacactgaacttgagaatggagtgctttgggaagtgcaagggaagtgggttgttcagggagctgttgatgtgaacatcggggcgaatccatctgctgaaggtgcagatgaagacgaaggtgttgacgatcaagccatcaaggttgtcgatattgttgacactttcaggcttcaggagcaaccttcttttgacaagaagcagtttgttgcctacatgaagaaatatatcaagaacctaacacccaagttaggcgc

SEQ ID NO: 602 - DNA, 383 bp, Nicotiana tabacum
agctagaccgtgcaaaacagtcaacaaagtctgcaattctaatgaacctggagtcacgtatggttgcatcagaagatattgggagacaacttttgacttatggagagaggaatccagtggagcatttcttgaaagccattgacacaattacagccaatgatgttgcttctatggcagagaagcttatttcttctcctctgacaatggcatcctatggagatgttccttccctccccacatacgacgcagttagcagcaggttccattccaaataaaacaatttacaacaagcagcccgcagactcatttgacttgtccttatttttgggcatttgagaattttgagtgtcgatgttgcctcaatttgtggaaaataaggaatt

SEQ ID NO: 603 - DNA, 185 bp, Nicotiana tabacum
acgtgggacggaattcatctatttggtatggatgtgtgttaagaggtgatgttaacagcatcagtgttggatctggttccaatatacaggataactcccttgttcatgtggccaaatcaaatataagtcaaaaggtgctacccaccattatagggaacaatgtcactgttggtcatagtgctgtt

SEQ ID NO: 604 - DNA, 570 bp, Nicotiana tabacum
  modified_base (538)..(538): a, c, g or t
ccctttgatttgttgttgtcaactaggtcagtagaagtatgccagagatggaggatgtcaaagaccgaatagatggagcagaaaagccaatgccatcaaccaaacaggaagaggaagttgttaaaaagaaatacggaggaattatgccaaagaaaccacctcttatctctaaggatcataaacgtgcttattttgattctgcggattgggctcttggaaagcaaggtgtagcgaagcctaaaggtccactcgaggcacttcggccaaagttgcagccgacgaatcaacaaactcgataccgcaagtcgccttatgctccatctgagggtgaagatggaagcaatgcgccaccagaggatgcaactgcaaatgaatgaaagcggataatggccttcgagcttgtgatattgttcattgttattacatgtatgagcaatttctcttcagtattaagaaagcaaaatcaaagagtttgaggtgttttcatgtttatttgaggcaaccaaatcagtagctgcggtgttgtaactttggagtnatactttctgtgatcctccatttatgtatgat

SEQ ID NO: 605 - DNA, 302 bp, Nicotiana tabacum
aaagaaaggagaggtggcggtggatcgaaggcggagatgggacatgtagtaggtgataggaagagattaaatgaagcgttggataagcacttagagcggtcctctccctctacctccgctactactgttaggtgtgctaacggcaaggataatcacttttccatttccaaatcaaaggaccagctcaggaactctgctgctcctcctcctgataataagtgctctgatgcagaatctgaaacagacagtgaggcgtcagatattagtggttctgaaggagaagacacttcatggatctcatg

SEQ ID NO: 606 - DNA, 242 bp, Nicotiana tabacum
taggttgaattactattgcgacactgtcatcagtagggttaaactaacctgtctcacgacggtctaaacccagctcacgttccctattggtgggtgaacaatccaacacttggtgaattctgcttcacaatgataggaagaaccgacatcgaaggatcaaaaagcaacgtcgctatgaacgcttggctgccacaagccagttatccctgtggtaacttttctgacacctctagcttcgaatt

SEQ ID NO: 607 - DNA, 287 bp, Nicotiana tabacum
ttcatcagcaatgtcttgacacgtggctcgccacgcacgtgtcttgtccgctctgtaggtctactcagttttttaagaaggcggatgaggtttgtttagatgtgaatgaggtagaaaatgggaacggtgtgagtggctgatcgacggttcaagagtgtgacacgtgtaggaatattaggagatcgtgtaactattcgaacttaggaaatagagtggcattgcacagaagtgcaagtttctgaaaaagaatttgtgaaatttgtaaagatattgtaagtatactttgt

SEQ ID NO: 608 - DNA, 516 bp, Nicotiana tabacum
ttgctgcaaccaatagaccattcgaccttgatgaagcagttattaggaggcttccacgaaggctgatggtaaacctgccagatgctccgaacagggagaaaattttgagagtgatattggccaaggaagagttagcaccaaatgttgatctcaaagctattgctaatatgactgagggttattctgggagtgatttaaagaatttgtgtgtcacagctgctcattgcccaattagagaaattttggagaaagagaaaaaggaaagagcattggcagttgcagagagcaggcctgtccctgcattgcatagtagtgcggacattcgtcctcttaacattgatgattttaaatatgcacatgaacaggtatgtgctagtgtatcatcagaatcggcaaacatgaatgaacttctccagtggaatgaattatatggtgaaggtggatcaaggaagaagaaatctctcagctatttcatgtagagacatttgaactgtatagcattgctttatttatttg

SEQ ID NO: 609 - DNA, 226 bp, Nicotiana tabacum
ggaataaaagttaactgtgtttctcctcattacattagcacaccacttgtattgaatgcgcttggaatagctgagagagagatagcggaaaaatggtttgcagcaggaggaaatttgaaaggagctttactagatgaagaggaggtcgcaaaggcagtgctatacttagcaagtgatgattctaaatatgtgagtggtatgaatctggttattgatggtggtttta

SEQ ID NO: 610 - DNA, 457 bp, Nicotiana tabacum
tggagctgccaaggctgttgggaaagtcctaccagcattgaatggaaagttaaccggaatggctttccgagtcccaactgttgatgtgtccgtggttgacctcacagtgaggctggagaaagaagctacctacgttgaaatcaaggctgccattaaggaggaatctgaaggaaaattgaagggaattctaggttacactgaagatgatgtggtgtccacagacttcgtgggagacaatagatcaagcatatttgatgccaaggctggaattgctttgagcaagaattttgttaagctcgtttcgtggtatggggttacacgcacacgagtggtggacttgattaagcatatggcatcagttcagtaaaagtggcagtttactcattggtggccaagtgtagtggtgctgctgtgaggagtctgttatttgttactagataaagcagtttagaataaa

SEQ ID NO: 611 - DNA, 523 bp, Nicotiana tabacum
agagtcagttagcgcttcactctggaggttcgtcaccttatacatatcttgaactccgacagatggctgcaggatacatgaggaaaaatgctaccaattttctcccgtttttcctctctgagaatatgacagaaggagaatcggacgattctcttgtggaaaggtttgagaattactgtgtagaagtggagacaaccgcagcatggggcggacaacttgaactcggtgctctaactcatatcttaaagaaacatatcatgattttttcagggtccttccctgatgtagagatgggaaaagaattcaaatctgatagcagcactatttcttctaatttaagtataatgctatcataccacaagcatgcatttgggctcggtgagcattataactcggttgtccggagtttatcctgagaggtatgttctatatcatgtggccaagtgtttccagcaactatgtttttgtaagcttatgttgtcctcttggtttacaacaatctgcagttaacataccattttct

SEQ ID NO: 612 - DNA, 453 bp, Nicotiana tabacum
ctaaaagggctagctatatcagagtcattatgttggagttgagtcggatagcttctcatttgttatggctaggcccttttatggcggatattggtgcgcagacccctttcttctatatttttcgagaaagagaattgatatatgacctcttcgaagctgccaccggtatgcgaatgatgcataattattttcgtatcgggggagtggctgccgatctaccctatggctggatagataaatgtttggatttttgcgattattttttaacaggggttgctgagtatcaaaaacttattacccggaatcctatttttttagaacgagttgaaggcgtaggcattattgggggagacgaagcattaaattgggggttatcgggaccaatgctacgagcttccggaatagaatgggatcttcgtaaagttgatcattatgagtcttacgacgaatttg

SEQ ID NO: 613 - DNA, 557 bp, Nicotiana tabacum
agagtgatttcttagcacaaggttttggatcccttgggttgatgacatctgtcctggtgtgtcctgatggaaagaccattgaggctgaagcagcccatggaactgtcacccgccactacagggttcaccagaaaggaggtgaaaccagcacaaacagtattgcatcaatctttgcctggactcgtggacttgcacacagggcaacgttagacaacaatgaaaggctcttggattttactgagaaactagaggcagcatgcattggtgcagttgaatctggaaagatgaccaaagatcttgcactcatcatacatggatccaagctctcaagagatcattatctcaacactgaagagttcatcgatgctgtggccgatgagcttaaagcaagacttctgaaagcaaaggcctaaatgtctgggctgaccagaggagagcctttttgtctggggcaattgagggatattaaagagaaataaaaggattagggcctgatggtatactaaatctcaagaggtttatttataggtgggggttactctccaggcattaatgtt

SEQ ID NO: 614 - DNA, 458 bp, Nicotiana tabacum
aaagacgaatggtggtgatagcagtgataatgaagctacaagcagtgtgaatgacagtggcagcagtatgcagaggttagggatatcttcttctgttgagaagaaggaagggatcaaaaggagtgctgtgggagatatcgctccgaccacaaggcactacaggagtgtttcgatggatagttttatggggaagttaaacttcgttgatgattcaccaaagttgcctccgtctcctggaccgcgcccaggccaactctcaccgaccagttcgcttgatgcaaatccaaacagcttcagtatggaatttggaaatggtgaatttagtggagctgaattgaagaaaattatggcaaatgagaaacttgcagagatagccttagcagatccaaagcgggccaaaaggattttagccaaccgtcaatctgctgctcgttcaaaagagcgaaagatgagataca

SEQ ID NO: 615 - DNA, 407 bp, Nicotiana tabacum
ctaaatctctttcaaatctggttgttcacatcatagacactcatgtggatcaccttcaagatgttgtgacgaagctggagattgagttggattcaatggagctggaattggacaaaggtggttttgctttgaagaaacaattgctggacgatagaaaatttccaaagatgcatcttgacctgcagcgcctcctccaggtgattgcacatggtgagcaagtatttccgcgagtgaaggagaaatgttcttcaaaaggttggtttgccagcgatgacatcacttcacttgaagagttaattggtcgactgagaagactaaaggagaatgttgggtttattgccaatcgtgtaacagcaattcaggcaggtcttgatagctggcagtctgagcagataaataaaaaactt

SEQ ID NO: 616 - DNA, 542 bp, Nicotiana tabacum
tggacgagggtggtcaaggagtcctacattttgcggcagctcttggttatgactgggctataccacctactatagctgcaggtgtaagcgtcaatttccgagatgtgaatggatggactgcactccattgggcagcatcttatggaagagagcggacagtgggtttcctcatcatctccttaggtgcagctcctggagcattgacagatcctactcctaaacatccttcaggaagaacacctgctgacttagcttctagcaatggacataaaggaattgctggttatttagcagagtcatccttaagctcccacctttcttctctcgagttgaaggaaatgaagcagggtgagactgtgcaaccctttggagaggctgttcaaacagtttctgaacggtcagctacaccagcttgggatggtgactggccacatggagtctcattgaaggattctctagctgctgttcgtaatgcaactcaagcagccgctcgtattcaccaagtcttcggggtgcagtcgttccagaggaagcagctaaag

SEQ ID NO: 617 - DNA, 393 bp, Nicotiana tabacum
aaaccctcagagagcttcagccccccatttattattctctttttctttgaaatctgaaagggaaagagaagcagaaaaagaaatgggagagaagccaaaatctggaggtgtttggcccactgttaagcccttcgttaatggaggtgcttctggtatgcttgccacctgtgttattcagcccatcgatatgatcaaggtaaggatacaattgggtcaggggtcagcagttgatgtcaccaagaccatgcttaaaaatgaaggctttggtgccttttacaagggtttgtcagctgggcttctcaggcaggcaacctatacaacagccagacttgggtcattcagaattttgacgaacaaggccattgaggccaatgaagggaagcccttgcctct

SEQ ID NO: 618 - DNA, 424 bp, Nicotiana tabacum
aaatctcaggtaaaagtgatgttacagaagctgcaactatggatttattgacaattatggaaaaaccctctattgaaactaaagaacaagaacaaaaatccacagatcccgttcttcagcgtgctgcaacagagttttctagagatatggaggtggccgtaaatgagcccagcacgagcaaagaggcgccaaaggagcctaaggcagcacaattgactatgttctatgatggtaaagtgatagtatttgatgattttccagctgacaaagctagagcagtgatgttattggctagtaaaggatgccctcagagttcatttggcacttttcatactacaaccatcgacaaaattaacacatctgctgctgccgctgccactgccttctttgacatgtaataaaactgatcatcagcttaaaccaa

SEQ ID NO: 619 - DNA, 478 bp, Nicotiana tabacum
tccacgtcatcattaccgtcgccgacgattttgaagaggaaaagaccggcgaggattacgattccgattgcatctttgagattagaacaggttgatcaaactccgagggaagagagtagtaggttagatgaagtggaagttgaaggagaaggatactctgtgtattgtaaaagagggaaaaagagaggtgatatggaagatcggtattcggccatagttgatgaatctaaggacggctctaaacaggccttttttggtgtatttgatggacatgggggagcaaaagctgcagagtttgcagcaaagaatttaggcaggaacattataaatgaagtagcgttaaggagtgaagacggagttgaagaggcagttaaagagggttacctcactacagatacagacttcctaaagctaaatacaaatggaggaagttgttgtgtgacagcactgattacaaaaatggacaacttattgtatc

SEQ ID NO: 620 - DNA, 242 bp, Nicotiana tabacum
gagggtgaaagagcaagaaccagagacaacaacttgctgggtaaatttgagctctctggtattcctcctgctcctaggggtgtgcctcagatcacagtctgctttgatattgatgccaatggcatcttgaatgtctctgctgaagacaaaaccactggacagaagaacaagatcacaattaccaatgacaagggtaggttgtcaaaggaagaaattgaaaagagggtccaggaagcagagaa

SEQ ID NO: 621 - DNA, 234 bp, Nicotiana tabacum
tgttgaaggagactagtgaagcgtgcttagcagctcttatacggccttcgtcgcatcatcagaggcgtagagccgatttccaacctcgtcccagccggctttccaggatgtccaaagctgaggatctgtgatgttgtgttaaggttacaggtttgatattttaatataggtatttgaagctattcagttgagagtttccggcgatggcgtcagatcccggctgcggtttttata

SEQ ID NO: 622 - DNA, 284 bp, Nicotiana tabacum
agtaatgatgtagcacagtgtgttatggagaaggcgaaacgattttgcaaggacttggatggggttaaggtggagacgatagtggagcgcggtgatgcaagggacgtgatttgtcaggcggcggaaaggttacatgtcgacatgctcgtcatgggaagccatggctatggtgtcatcaagagggcatttcttgggagtgtgagcaaccactgtgcacagaatgtcaagtgtccagttttaatagtgaaaaagccaaaaaccaatggcagcagcaaatagatttt

SEQ ID NO: 623 - DNA, 432 bp, Nicotiana tabacum
tctattatggtcatgcagcagctccaaatgacaagacattgcgagagggagatatggctcttcttgatatgggagctgaataccacttttatgggtccgacataacttgttcctttccagtaaatgggaaatttactcgtgaccagtcacttgtatatactgctgtcctcgacgctcacgatgctgtcatttctgccatgagccctggagtgagctgggtcgatatgcataaattagctgaaaagatcattttggaatcactgaagaaagggcacctacttgttggggatgttgataaaatgatgaccgagcgacttggtgctgttttcatgcctcatgggttggggcaccttcttggaattgatactcatgatcctgggggttacttgaagggagctgaaagaccaaaagaacctggattgagctctctac

SEQ ID NO: 624 - DNA, 626 bp, Nicotiana tabacum
cgactatcagctgatggacatctctgaagatggttttgtgtctcttcttactgaaaatggaaacaccaaagacgacctcaggcttcccaccgatgaagccctgctgagccaggttaaaggtggatttgaggaaggaaaggatcctgtgttgtctgtgatgtctgcaatgggtgaagagcagattgccgctgttaaggacattggtacataaaacaatgtattataaactcgttgatgcttaaacactctgtttgacatcaactgattataaaaagttctttttacagcacagcattatctaatatctagcacactgtttgcagagcttattcacattggcaaaccactgacttcacactccaaaatcaagttgcgacaagaccatcttttacttcctctcctccttcccccagttgccaaacaacgtctttcaatccagtagacaggttcttgtaaaacttgtgaaattccaaggtatctcctccagccttgcgaagctcaaccatgtatagtgaaggtgccaccatcgtaaatctcggttgcaacggataaatgacctttgcgcccgctcttctccccctgaagcttaatcttgtagttattcttcctcacattgaagcccagag

SEQ ID NO: 625 - DNA, 241 bp, Nicotiana tabacum
tctcctaacttgcgttgtgctgctttggatgccttgactcaccacttttttgatgagcttcgtgatcccaatacacgcctgcctaatggacgtttccttcctcccttatttaactttaaggctcacgagttgaagaacgtgcatgcagagacattattgaagttggttccagagcacgccagaaaacagtgcccgtcccttgggttatgagttccttccgaatgatagaaataatttaagt

SEQ ID NO: 626 - DNA, 309 bp, Nicotiana tabacum
acaggagaccacaaacaatgcagtcaacagctgttcaacgtggatcagtggcttagcaccgatcgttcgccgtatcagttgacggccacaagaaacaattgtaggcgtatgtcaggtgaccaacaacccattgttgttgatgtaatttaattcgagttcattgggctacttacaaactatatacttatagaatttctctccttctttctttgtatctctctctttcaattatataccagtgtgtggcaattttagcatcaatctaatgttgtataatctgtgaagcccatttaggccaaggcctgatgt

SEQ ID NO: 627 - DNA, 352 bp, Nicotiana tabacum
ccaattccttctcgtgtcttgacaggaaggcgtgaaatgtgtgtcattgaaaaagagaacaacttcaagcaggcaggagagagatacagatcctgggaacctgacaggcaagacagatatgttagcaaatgggttgagcatttatctgatccccgagtcacttatgagatacgcagtatatggatatcatacttgtctcaggctgacaagtcttgtggtcagaaggtcgcttctcgtctcactgtaaagcctacaatgtgatgaagctaagatgaaaacgctactgggaaaacgtttcaagttgcatactaaaccaagaaaaacattacgtttgtttgttgtgctataaagt

SEQ ID NO: 628 - DNA, 371 bp, Nicotiana tabacum
ttcaatgtgatcggctcagaccctgaaggaaggttaggagaagctccacggccagaattacgtgagcaaggtcggatatctggtgcttgttttgatgcagccaggggcataattccaggattgaagataagaggagtagattacatcacaccagatggcacttgtgtaagagactatatcgatgtgactgacctaattgacgctcatgttaaagctctcgagcatgcaaaacctagcaaagttggcatctacaatgttgggactggaaaaggtagttcagtgaaacaatttgtggaagcttgtaaaagggcaacaggagtggacataaagattgattacctgagtagacgtccaggagactacgctgaagt

SEQ ID NO: 629 - DNA, 468 bp, Nicotiana tabacum
aggaagatttactgcatactccgaaaattgacatagcacaggaagcactaaagttgagttccttggagttgcgtgcaggggtgaaggaccctctccctgaggcactggaactagctaaggctctgatgtccttgggcagggatagtagtgctcagcaacctgcagaaaatgaaaacggaagagcccctcatcttgtggttgatagtaatggagtggttcaagctaatggcgggaatgaagatgaccagatcattggtcttcaaaatgctgcacccaagccaagcttaatggctcgaaacagcactgctcatacatttgagtggaacgattcaatcgataacttaagcgaaggatcaccaagtagtgggaggaggtttacgttacctacccccaggaggacgaaggtttcccccctgaagaagtatggatttaaaaaagttacaaagaggaggaaatccaagagatgga

SEQ ID NO: 630 - DNA, 346 bp, Nicotiana tabacum
tttgatcgatcaggtatgaaggcaatagactgtgcatatccatgcgatagaacatgtcacaacctgatctttagatgagccttaaaatcaaattctttttctgctaacagcagaaatatgttatcatcttgatagtgaaataccccttccaattaacttaagatttacacaagtgtaacaaagttggttgtagaaaataatgtctagcatttatccgcgaatgcatttagtatagtaatgctccacttatgtcctttttgggccagttagagcaggagatttttatttatcattttctgtatccacccaaaatttattgaattgtaaaacaaatcaatccaatgaa

SEQ ID NO: 631 - DNA, 342 bp, Nicotiana tabacum
aattatgtcaagcttgatgggctcaaatggtttggtcttggcaacagccatggctgtctctgccggcactgtgcttctttttgatcttcttcaggaaaagtatttgtcaactattcagtttgaacttacaaacaataaacaagaatattccccacatggagagcatattctaaagtcttgtttatcttcaggtgaaaagaacaaagatttgaggagaagaagagagttcattttgcagctaatgtgaaagattcaaatggaaatggcgaggaatatagaagggaatttaattatagcaaagttcttagtaattcttgtggtatgccagaatcgtagaacttt

SEQ ID NO: 632 - DNA, 315 bp, Nicotiana tabacum
atgcgatgcgggacacctagagggaaagagaatgcagttgctgcgttgcttgaattatgccgtggtggtggagctgctgctacagagagggtcttgaaggctccagcattagcaagtttacttcagacattgctctttacaggaacgaagcgcgcaaggagaaaagcagcatcgcttgctagagtatttcaacggtgtgagcatgcatcaatgcattatggcgggttaggtgtaggatatgcttttgctggagactcagctacagttagggattcaacttttgctggtgatgtctcagtttccatgtccatttca

SEQ ID NO: 633 - DNA, 203 bp, Nicotiana tabacum
acgtgtcggcgggttagagagcctcgtggcacttcacttgagtggccgtcttgttcctaggcttgtggaagttggtgtcatcactgatgtggtattgtaaaattaagataattatttcgtgtttttatggagctatgttttgtaattcaattatcgtgaaaaagaaaaaaaaaattatacccttaggaaaagaaaataattaa

SEQ ID NO: 634 - DNA, 362 bp, Nicotiana tabacum
aaagcagatatattactttgtgaatctggtggagacaacctagctgccaacttcagtagggaacttgctgattacataatctacataatagatgtatcaggtggtgataaaattcctcggaaaggaggtcctggaattacccaagcagatctccttgtgataaataaaactgatttggcaccagctgtaggagcagatttgtctgtcatggagcgtggtgcacttcggatgcgggacggtggtccttttgtttttgctcaggtgaagcatggggttggcgtagaggacatagtgaaccatattttacaagcttgggtagttgcaaccggcaataagaagcactgaaatgtcaacgaaaacta

SEQ ID NO: 635 - DNA, 276 bp, Nicotiana tabacum
aaagctcacaggaacatcatttttctctgttgcaacgtgagactgaaaagcttcggaacgacattgaaaaaatgcgcagtgaactaaggtatgagattgacaagcttactgccggccaacgtttggatttaaatcttgaaagaggacgcattcgtgatgagcttgccaatcaaaatgcagaaactacaaatcttacaaataagcttgatcgggaaattcatgcattgagggcacaactcgaagctgcaaaatatgaagtgatcaaatactgtatag

SEQ ID NO: 636 - DNA, 532 bp, Nicotiana tabacum
tagacagttctaaaagcagaagaaatggaacgttaggggtgaataataataataataatgtaatggaggatgttttcaaggtgatggacaaagatggtgatggcaaagttggggttgaggatcttaagagttatctgaattgggctgggcttcaagtggatgatgatgatattaaggccatgattaaattgggccgtggtgatgaaaatggtggtggtgtcacctttgaaggttttctccaaattttgtctcttcgatttgttgctttgatgacgatgataaatgtcagattaggtgaacaagttttggtttactttgtatttttcaatgatttgttttactgtgctgcttcatatgctattggctattccgagaattctatttgaaaacaaagaagaaaaagagttgttccgccagcattttgttattatttttttatattgtttgttttcgttaagtgagaaatgatgttcgaatgaggtttatttaagtcgagttttattcttagaattaaagccgagtatatttaagg

SEQ ID NO: 637 - DNA, 314 bp, Nicotiana tabacum
aagacactctggctgcaggatagtccaactgaggatataacaagtattctctatgatgtctttgattattttgaagatgttcgtgaacaaggtgggagagtttttgtgcactgctatcagggagtgtcccgatcaacctctttggttattgcatattttatgtggaaagaggggttgagctttgaagatgcattccagcatgtaaaagctgcaagaggagtgacaaacccgaatatgggttttgcttgccaactattgcagtgccagaaacgagtgcatgccctacctgtgagtccgagttctgtgcttagaat

SEQ ID NO: 638 - DNA, 353 bp, Nicotiana tabacum
tctacgcaatatacagcaaaaaggagaaggccatattaaaggagcaaaaacttccagagatacaaaagccagaagtcatagtggtggacgagaacatgaacagtaaaaagcttccagaactgacacaggaacagattattgacatagtgaagcttggtttactggtttgctcagataaagttaacgtagcctcgcttccacatgatactacttgtggagttaaagcacctaaagtagaaaacatgcccaagctgcaaactgtagaagcctaggacagttaatgtcaggcttggaattagcattgatctcagtgcagcatatatatagttttcctaagtaatcctggtgtgtat

SEQ ID NO: 639 - DNA, 356 bp, Nicotiana tabacum
ccaaatttctgctgcttcaggtgggaataaggatagtgtttctgaggacattgatactggaggagattctcttccagatataagtcaaatttctaaggacgcagacagcatgtccgatattctcatgcctcgtaaaaagaggaagctactagatgctatgaagatgggcaaagagaagaaacaagctaatgttgaccgtttgaagcagaggaacagaatgattaaagaaggaaaaatatcagagaaataaggaagcagttaattatgccagtcatttaaaattattcactgcgttgtagtctttcgtttgcttttcttttggactggtaattctataatcttgtatattggtttat

SEQ ID NO: 640 - DNA, 429 bp, Nicotiana tabacum
taggtcgtgatggttctatcctcattgaaggttcagacgctgcgagaactgctatcccaaacagaaatttgaaaggattcgacgttattgaggatgctaagacgcaaattgaagctatctgtcctggagttgtttcctgtgctgatattcttgctctagctgctcgtgattccgttgttgcgactaggggactgacatggtctgtgcctacgggacgtagagatgggcgagtttcgagagcagctgatgcgggtgacctgccagctttttttgattctgtggatattcaaaagcgaaagtttcttacaaagggtctcaacactcaagatcttgtcgccccttactggtgcgcacactattggaaccgcaggttgcgcagtcatcagagacaggctattcaatttcaactccactggtggccctgaccct

SEQ ID NO: 641 - DNA, 449 bp, Nicotiana tabacum
gacgttgaacgagacaacgaaattaactgcaaagtctgcgggctgcaaattcttggctcggcttatggttgtcaacgttgtcaattttacctacatgtttcgtgcttcgatctgccccaaaagattcagcacgattctcatcctgctcatcctttaacgcttcgaaatctttcctactacaagaactgtggaaaatcttgtgatgcttgttgtgaagatatacgacgaagttttctatactgttgtgatccttgcaattttgatcttcatgttacttgtgctaccttatatagcattgcgaggagaaatgattcaccaaaggatactcttcgactttactactcgtttcctgtcagtgacaacaatcaaatgcattggattgcgcgatgcaatgtttgtaacaagaaggtgtctaaggaaggttggttatattatagcaaggatactgg

SEQ ID NO: 642 - DNA, 500 bp, Nicotiana tabacum
gtgatatcatatggcaggagcgaagttgcttggtctttggtatagcccttttagtcacagagttgagtgggctctgaagattaagggcgtggaatatgaatttatagaagaagatctacaaaacaagagctctctgcttcttcaatccaaccctgttcacaagacaatccctgttctctttcacaatggaaagccaatagctgagtctatggtcattcttgaatacattgatgaggcttttgagggtccttccatcttgcctaaagacccttatgaccgtgctatagctcgtttctgggctaagttcctcgaggataaggtgccagcggtggggaaaagtttctttctcaaaggagaggagcaagagaaaggtaaagaggaagcttatgagatgctgaaaattcttgataatgaggtcaaggataagaaattctttaccggtgacaaaattgggttggctgatattgctgcaaatttttgtgggactttggctgggagtt

SEQ ID NO: 643 - DNA, 293 bp, Nicotiana tabacum
agttcgtgacatattttgagactatgccatggctagcagtcccatatgatgatccaacaatcaagaacttagctaagtattttgatatccgagggattccaagcctagtggttttgggccctgacggaaaaacagtgaccaaacaaggtaggagtcttatcaacttgtataaagggaatgcttacccattcacaaagacaagagtaggaatactagagaagcaaatggatgaagtagcaaaaggccttcctaagacagaacaccattcggggcatcgacatgaacttacgtta

SEQ ID NO: 644 - DNA, 444 bp, Nicotiana tabacum
aaagatcaaggatttgaaattttagcatttccttgtaaccagttcttgtggcaagaacctggaacaaatgaggagattcaggaaactgtatgcaccaggttcaaagctgaattccctgtatttgaaaaggttgatgtgaacggggataatgcagcaccacttttcaagttcttaaaatcaggaaaaggcggtttccttggaaatgctattaagtggaacttcaccaaatttcttgtgaacaaagaaggaaagattgtggaacgatatgcacccaggacacctcctcttcagtttgagaaagacatacaaaatctgttgggttcttcttgagcatccaggattattgaaaagcatctgttattctatcagccaagtgtgaaactccagcctttaattggaatgtttaattagtatatctttttcatcttccctgcctatgagctt

SEQ ID NO: 645 - DNA, 658 bp, Nicotiana tabacum
  modified_base (575)..(575): a, c, g or t
  modified_base (578)..(578): a, c, g or t
  modified_base (581)..(581): a, c, g or t
  modified_base (603)..(603): a, c, g or t
  modified_base (609)..(610): a, c, g or t
  modified_base (629)..(629): a, c, g or t
taacttcgcttctgccgctgctggctatgacgataaaactgccatccttaaccatgcaattccattgtcaatacagatgcaatattacaaggaataccaagccaagctaacaaaagttgcaggcagccaaaaagcggcatcaatcctaaaggatgcgctctacttattaagcgcaggaagcagtgatttcttgcaaaattactacatcaatccttatattaacaaactctatactcctgatcagtatggttcttatcttgtcggcatcttcactagctttgtcaaggatttgcatgcgcaaggagcaaggagaattggagtaatttcactgccaccattgggctgtcttcctgctgctagaacattgttcggatttcacgagagtggatgtgtctcaaaaatcaatacagatgcccaacaattcaacaagaagatgaattcagccgctacacaattacaaaaacaactcccaggccttaagattgctatctttgacattttccagcccctatatgacctcgtcaaatctccatcagatcatggattcacggaagcaaatagaggctgttgtggancangancagtggagacgacgtcgttatngtgcannccaagtcaccagggactgnagcatgcactcagtatgttttgggatagt

SEQ ID NO: 646 - DNA, 461 bp, Nicotiana tabacum
aagaatggaccagttgaggtctcttttactgtttacgaggatttcgctcactacaagtctggagtttacaagcgtgtaactggtgatataatgggaggccatgctgttaaactcatcggatggggaacctccgaggatggagaggactattggcttcttgccaatcagtggaacagaggctggggtgatgatggttactttaagatcagaagaggaacaaacgaatgtgaaatcgaagatgaagtggttgcaggattgccttcagccagaaatctgaacgtggaacttgatgtctctgatgctttccttgacgccgcaatgtgaatgctaattcttcaactaaacactaaatagaatgcaagtttctgaagactggggaacaataacatattaagtttattattcttcccctcttaagttgtctgcaattgttccactatcttattatcagtggaagtgct

SEQ ID NO: 647 - DNA, 331 bp, Nicotiana tabacum
agaaaggcaagtggccaaacttatggaagaaaatgttggttctgcaatgcaatttcttcagtctaaagcactatgtattatgcctatttctcttgcatcagcaatttaccactctcaaccaccagatacatcaagtcttgttaagccagaaactaatcctcctccttagagacccaaaactggttcgaacactaaaccggctcgaacactacggttattttaaaaaaaaataaaaaattgttagaaaggtgacaacatgctaatgaccctgagaattctctttgggagtggatggtcccacagccatggttcctgctattacttattaaga

SEQ ID NO: 648 - DNA, 350 bp, Nicotiana tabacum
gtccggattcgaggattttgttcgagtcgatggagaaattgttaattctacaaattcagaaggttctgatgagagcgtagtggaagaacgatggggttgatgaggtttcttcggtgaatgaagaaggtgaaggtcaaagtcaaccatacgaaaggagggttttgccggaggaactttcgaggaatgtaatgacactcacttgtgaatcttctgccgatggaggcatttgcgatgtgtatgttgttggcacagctcacgtttctgcggaatcctgccaagaagtcgaagccgtgatcaattttctgaaaccgcaggtcgttttcttggagttatgctcgggtcgagtggct

SEQ ID NO: 649 - DNA, 251 bp, Nicotiana tabacum
aatcatcaaataaagaggaggtgccttctactgtatttgcatcacagagcccatatgtggaggctccacagtttgccggtggtcaactcagctataacttccccatgccgactgcaccaccaggtgcacagagacatgcatagatacggagtttgcgaagaatttatgtagcttgtgaatggtagtgcttgttgttgtatggctttttcttagggaagagagggagtttgagcttcttatgtatccagtgt

SEQ ID NO: 650 - DNA, 271 bp, Nicotiana tabacum
ctaattgcaactttgatggtgcgggtagaggttggtgccaaaccggtgattgtggtggagtcttagaatgcaaagggtggggtaaaccaccaaacactttagccgaatacgcgttgaaccaattcagcaacttagatttctgggacatctctgtaattgatggatttaacattcctatgccttttggcccgactaagcctggtcctggaaaatgtcacggaattcaatgcacagccaacataaatggtgaatgccctggttcacttagggt

SEQ ID NO: 651 - DNA, 513 bp, Nicotiana tabacum
ccattagttgatgaagatgcaggaagctctgcgccatttatgaaactgatgtcttgttttcattgctttcattgtgagcgcatcatcagatggtggaattggcttcaactattaaaagaatctgatgcccctacggactctggttctgcttcgtcttctaggaacagggatcaggatgaagaagatgtggggaagtgcccggtttgtcgcaagtcttttctagcgaaggacattgagcacgtgctagacttcgtgaagactcagcatgctgtgacttccagtggatctgaagtcaacaatgaagacaagattctttcctcggactcggaaaaactaagaagaaagaaatttgatgctattctgaaactccagcaagagaagggtggcttaattgaaataaaaaagcatgaagtgttgcggccaggtatttatcttccacaacctgctgcattaccctcaactgcacccaccgaagaggcaaatgagcaaaaagacagagatctggcagccaac

SEQ ID NO: 652 - DNA, 241 bp, Nicotiana tabacum
ctaatctggaaaccacattcttaccagaaggcagtcattttgtgcaggagcagtttcctgaacagatcaatcagttgattatcaccttcctcaaaaagctcaaatgatgaactgctttccagcgatatcgaataaagggcgacccaatgcacgaaactcccgttatgcacaaggtttgagaaggacaggcatttgggtcttatttttcacagttgaatgttgatctaatttttatcaaaca

SEQ ID NO: 653 - DNA, 392 bp, Nicotiana tabacum
caaaacgacaatggcgcgatggttcccctacgtgctcacactgttttgatctccactcaacatgacgagactgttacaaacgatgaaattgctcgtgatctcaaagagcatgtcatcaagcccgtgatccccgagaaatatcttgatgtgaagaccattttccacctcaacccttcgggccgttttgtcattggaggaccccacggtgatgctggtctcactggccgaaagatcatcatcgacacttacggagggtggggtgctcatggaggtggtgctttctcggggaaggaccctaccaaggttgacagaagtggagcctatattgtgaggcaagcagcgaagagcattgttgccaatggtcttgctaggaggtgcattgttcaggtttc

SEQ ID NO: 654 - DNA, 341 bp, Nicotiana tabacum
ttcagacagtccctgcttctcctccgattaaattgtccagatgcagcgatgaggagtttacatttggcccgccagcatgcatctagtgaacatgaatgtttggtctatgagggatggatcttatatgatactggccactgtgaagaaggtctacagaaagctgaagaatctattcgcatcaagagatcttttgaagcatactttctgaaagcctatgctttagccgactctagccctgatgcatcttgttcatcaactgtcatatcacttcttgaggaagctttgaggtgcccgtcggataggcttcgcaagggtcaggccctgaacaatcttggcagtgt

SEQ ID NO: 655 - DNA, 207 bp, Nicotiana tabacum
gcaactccaagagatcgttccgtgtaaaatccgtgccgaacgtggttgtgctactcatccaaggagcattgccgagagggtaagaagaactcgaattagtgaaagaatgaggaaactgcaggagcttgtcccaaacatggagaagcaaactgaaacagcagacatgttagatttggctgttgattacattaaagacctccaaaaaca

SEQ ID NO: 656 - DNA, 398 bp, Nicotiana tabacum
tatgcgggctatgcagggtatggaaattatgcacaacctccacagcaacagcaacaaatttcgcagcagccccagtaatctgctggtcaaaggtattgctgagagcttcccgtcatggtaaagcattgttgttgaaaagcggagcacatgtctgttgaatacagaggtagtatagtttgctatctgtgggttggttcttggatgatacatttgtgttctgtgcagctgtctgtttcaatagctggcttcttttctatttcttttttctcgctacattgctcttgtgccatttttggttatatttgtgatctagctatgttagatctcagatgagatcaagggcatcttttttttttaattcttacatggtggttttggcatgtcagacagttgtgtat

SEQ ID NO: 657 - DNA, 297 bp, Nicotiana tabacum
ttggcattcttggagaaaatactgaggttgttctagcagagtgctcaagatcatttggcccatggatgatggcacatgctgtagagttgttgacagctgggagcactcatgcggaaattcttttgcatgaagagcagtccaaactggggggaatcagcatagaagagctccataaacttgtatatgcacaagttctgtcttcccatgcgttcacatggcaaattgctccaatatacttgacttcatgcataaaacaagggattggattgttggatgaatttgctttacaagcagcct

SEQ ID NO: 658 - DNA, 363 bp, Nicotiana tabacum
  modified_base (110)..(110): a, c, g or t
taaccctagaagaagcaaatggtgcagcaactggaaagacgaaaaaattgattgatatggctaacagaagaggaccttacttgggattagtcattcctaacctgtttgangatgaatcctcttcttcaacaccctagttacaaacctactaaccttaccattgactatgcagggaggatgatttcggtttggatatattgataaccagcctgttgttcttgttatgactggacttgccatgctaaatgcaggcataacaacacaactgttgctagcattgttcaaggttaaaggtgtggtgcactatggaattgcaggaaatgcaaatccctctctccatattggagatgttgctattcctca

SEQ ID NO: 659 - DNA, 303 bp, Nicotiana tabacum
gaagctgttttcattcgttggtgctaaacgtgagaaaatcaagaatgattttcgaggggtattaatggattactgtaaaagcgaggaagattgttgggcggttgattgcgccaccggcatatgttccgacggagctccggcgataatggaaacgtttcttggttcagatttctgtttacaaccaagaggagatgggttgactagacggtcaatgtttgactgtatgttggccggttcaattccggtttatttttggaaaggaacatttaaaggtcaatatgaatggcatttgccgtggatgcc

SEQ ID NO: 660 - DNA, 424 bp, Nicotiana tabacum
atttaacatgctttcaagtttcaaccacaaaaaaaaacaatatactaagaataaaatagtgaagaaggagaattggaccttcactaatgtaaaaccatctttagcataatggaggaactccatagaagttggaacaaaagctacaaatcgcgacagacccacgaccggaaacctcgaatctcgccgggtaaagctcgtcggaaacctcgactcgaaacataagcatgagacgatactcgacttggaaaatgccgctatttatgtaaaaaagagggactactttaaggtgttttagagatggtcttgggtttgttccatggaagcttcaaggtgagctttgggctggtattcatggctgcgtttacatggagtttcagcttgtttttaggtcgtttttggctgattttcgctgggatattgagtc

SEQ ID NO: 661 - DNA, 386 bp, Nicotiana tabacum
cccgacttggagaacaccaccacctttaccatcattgagggagttgcacctatgaagaactatgagggatctgctgagaaagcaacagaaggaggaaatggctgcaagtgcggagcaaactgcaaatgtgacccttgcaactgctgatgaacatggtcattagctggcccaaaaatatattatgtgttttaaaagctttgtagtattaataaaactacaaccatgaaactgaccatctccaaatctttttgacaaggtttgtttgatgttgtttcatggtttttctgtttggttttctaatatgatatttgtatgaaaggaagctgatttgggctgtaacacgaacttatcaatatatagaatacaagttggcttctcctttaaaa

SEQ ID NO: 662 - DNA, 465 bp, Nicotiana tabacum
ggatttcaaacccaaatggtctgaattctccggcgaactttgccgccgacgtatcttcttctctgccaactttcgctgccgatcgtattatcagggagtttcgccatggaagatacagagtcagttgcaacattggtggactctacaacatccaagatacagcaactacagaaagcattcgctgagttggaaagtcaccgtgctgttactctcaacctgcagtggaagcaacttgaagagcactttcatgggcttcagaagtccttgaagaggcgtttcaatgaactggaagaccaagagaaggagtttgagacaaaaattttccaatctagggagatgttggagaagcgtcaagcagctgttattgctaaagagcaagcttcacttcagaggctccaggggaaaagagatgctgcagtttccgctattgctatcgctcttgagaagcataggaagccttgttct

SEQ ID NO: 663 - DNA, 252 bp, Nicotiana tabacum
ggtgagattgtgtaattgtcttacatcttgtgtggcctgtttttgaattttcagaaaatgttgggtgtatttagcagttccattgtttccccgcccgacgagcttgtggccgccggaagccggacatccgatcgcctaagatcaaggcggaagcatctggtaaaaagatttgttcaaaataattcgtcggcggtttctatgcagatcggcgatcatgtccagctcgcttacactcactacaacgagtccgct

SEQ ID NO: 664 - DNA, 271 bp, Nicotiana tabacum
atccgtgcaacagttttgtgaccagctgtttaaaaagagagatatttttccacccaaccaccacaggctctcttgaaagaagaaaaagaacaaggggtgccttttattccaattgtgcagtttttttttctttgttaaagaataaatttcgtcaaagaaaaagaagctgttctactggatttattagcaaaatatgttcttcaattttggctaaattcttcccatttagaagtcagcagcaccatattactcccttttctcagggcatgat

SEQ ID NO: 665 - DNA, 490 bp, Nicotiana tabacum
tttaaccggttgaaagaactctctacaaaccttcagttggctccacgtttaaggtgtatggttcttgatgtgctggatttacgttccaataactgggtgcttagacgggaagaggggaaaccaaaaatcatcacagagattcacacggaagcaaagaccttgaagttgcgttctggtgccactgcaagcatgagaaactcacgtggtcctcaaggcggcttgatttctagcggctatcggcgaggaactggtggtatgacgcctggaatgccgggagttaggaagatgccggggaggacctgctcctatactagtcaaagccgagcagcgatgttcagcagctcaaaaaagcgtgtcttgaagactgttatgggtggactcaatgagccgactctgaagaagtttgatctcctaaatagacaattgataattacagggataactagtgcagacattctgaagggtgttgttaccttgatatttgacaact

SEQ ID NO: 666 - DNA, 417 bp, Nicotiana tabacum
agttaaagaacttgaggcatacacagatgccgtacaaagatgggatatcaacgaaattgatcggcttcctgattacatgaaaatcagttataaagctattctagatctctacaaggattatgaaaaggaattgtctagtgccggaagatctcatattgtctgccatgcaatagaaagaatgaaagaagtagtaagaaattataatgtcgagtcaacatggtttattgaaggatatatgccacctgtttctgaatacctaagcaatgcactagcaactaccacatattactacctcgcgacaacatcgtatttgggcatgaagtctgccacggagcaagattttgagtggttgtcaaagaatccaaaaattcttgaagctagtgtaattatatgtcgagttatcgatgacacagccac

SEQ ID NO: 667 - DNA, 322 bp, Nicotiana tabacum
gtttaaacgtgaatttgaggcttttggtccaatcaagcgggttcgtttggttacggacaatacaaacaataaacccaggggttatgcttttattgagtatgttcatacacgggatatgaaagctgcatataaacaagctgatggaataggaagattgataatagaagagttctggttgatgttcgaacgtgggagaacagtccccaattggcgaccccgaagacttggcggtggacttggaacaacaagagttggaactgaagatgttaatagagaggtagttcagattggaagggcggcatctcgctccgaagagccaaga

SEQ ID NO: 668 - DNA, 399 bp, Nicotiana tabacum
gtgttcagctaagctagcccgtcaagcacagagtaaagaaaaaacattggctaagatggagcgtggtgggcttacagagaaggtggggagggacagtgtcttggttttccggtttactgatgttggcaaacttcctcctcctgttttacagttttcggaagtcgcatttggctacacacctgagaacctcatctacaagaaccttgattttggtgtagatcttgattccaggatagcactagaggggcctaatggagctggaaagagcacactgcttaagctgatgataggggacttattccccactgatggcatggttaagcggcataatcaccttaaaattgcgcagtatcaccagcacttggctgagaagctagacatggacatgtctgctcttca

SEQ ID NO: 669 - DNA, 235 bp, Nicotiana tabacum
tccaagatcgtaacggctcttcaaaaaacgcaaaatggacagtcgaattcgtcgaaaaaaccgacaacgttatacgcttaaaaagttgctacggaaaatatcttacagcgtcaaatcagccatttcttttaggtatgactggtcggaaagttttacaaactgttccaaataggcttgattcttcaattgaatgggaacccattagagaaggacatcaagtgaagctaaggacaag

SEQ ID NO: 670 - DNA, 437 bp, Nicotiana tabacum
tcaatccactgttcttcctgatccttcttccttttttgcccctaatctcctctcaaatccattacccacaaattcttttttccaaaattttgtcctcaagaatggtgatcagcctgaattcatacacccttatattgtaaaatcctcactttcatccctcactctttgttacccatctcagttccataatcctgctttcatttaccaaaattttatagctgatttgactatcactgctttgaataaccccaatccaaattcaccccatgtaatttcatcctttgatgatcttagtgtcacattagaccttccttctagtaatctcaggttctttcttgttaaaggttccccctttattacgtgtaacgttcttggaaatgtagcgctttcgatttcaacaattcatgccattcttgagtgtaattcgaatagtaatc

SEQ ID NO: 671 - DNA, 334 bp, Nicotiana tabacum
tcgccttcgaacagcatgtctacaattgaacaaggaaatgtggtgtcacctatttaggtgtcccagcagaacaagaaccttgtccattttgcagaatcaaaggttgtttaggctgcgatattttcggaacaacatctaatgctgctgctgttgtcgctgctgacgataacaagaagaatagtacctgcccgggcggccgctcgagccagatgggtaactatccgatgggccaaatggggaatatgccggcagctcaaggactacctgcccccggtggggccgggtattaccccgggatgggacagggcaacccttatagccaacaacaacaaca

SEQ ID NO: 672 - DNA, 402 bp, Nicotiana tabacum
ggagtcaagattgtgttcacgggcttgcagttagtttagaaggccgcgaaactgcttggaaatggttgcaagacaaatgggatcatatccacaagacttacggctctggattcctattaacccgcttcatcagtgcaacagtgtcaccgttctcatcctatgagaaagcgaaagaagttgaagagttttttgctagccgcaccaagccttacattgcaagaactttgaagcagagcatcgagagggttcacattaatgcaaactgggttcaaagcattcaaaaggagaagaatctttccgaggcagtgatggagctagcgtataggaaatactgaagcagctgttgttgaacttaatgttccctttagagagtttctagtttccatcaataagttaatcatg

SEQ ID NO: 673 - DNA, 235 bp, Nicotiana tabacum
ctgcccgggcggccgctcgactggttttaccacagagaacatcgattatggtttatgagggtcgccaacatggagcctcttgtcaagaccagcgcctatgagagaggatcttatatatgttttgatccaaacacatgggaaacaatccgcaaggataattttgtgctccactatgagatgttggaaaatagacctgttctacctcagcactaacgattctgttcagcttatagtt

SEQ ID NO: 674 - DNA, 338 bp, Nicotiana tabacum
gtgcctctttctattaccagaccaagtgctgaggagtggccttgtgctgggtcggatgatcttggcgtatggcctaataatccccctactccaggtggtaggcttggaccagtcagcacccgtgaaggttcagctactaagcaggctccgcgagaatttgaattcaagaaagacaagcttgctttcttcaataaggaatgctctaagattgtggatcacatttatttaggaagtgacaccgtggcaaagaatcgtgatattctccatgagaatggaatcactcatgtcttaaactgtgtagggtttagttgtcccgaatactttaaggatgatcttgt

SEQ ID NO: 675 - DNA, 240 bp, Nicotiana tabacum
atatgacagcgccaaaacttgcaagcccgctcttgccactgctgtcttcagcaccgtatctttcttgcttggtgctgttacatctgtggtgtctgggttccttggaatgaaaattgctacatatgcaaatgccagaactaccttggaggctagaaaaggtgttgggaaggcttttattgttgcattcagatctggtgctgtgatgggtttccttctcgctgcaaacggtcttctggtttt

SEQ ID NO: 676 - DNA, 470 bp, Nicotiana tabacum
agcatggtgcaagaagaggttgaagcgaagacagcaaaaggctcttccagttgcacaaatggtcttctttggttgacaagggctatggatttcttggtggagctgttcaggaatttactggaccatggggactgggcgatgtcacaagcttgctctgattcatacggcaagacgttgaaaaagcttcatggatggttagcgagttcaagttttacggtggcaatgaagctcgctccagataggaagaaatttatggatgtaatatgtgggactggtgatattaacagtgacattggacagttctgcactactttctcaccgcttctcgaagagaaccacaagttcctggcctgcgtaggaatggatggtctaaaagcatcttaagtctaaaggaagtttgcaactcagttgagattcatccacactgtgagaaacttctgaaacaagcatacttcctgctttatcctgtt

SEQ ID NO: 677 - DNA, 278 bp, Nicotiana tabacum
agaagtcggattaggaaattataatgtgattggagatatttctctactggacaaaatggtgatatacgataatgagaaacaacaagttggatggcttccagcaaactgcaacaggctacctatcagtcgtgatcatggggaatattattatgatgcataccctaccaacatgggcatattcgaacagatatgtcctgcaaagtttgattcttcaaaacagcaggcaagaaaataaggtgacaaagtgagaagctaatgcgtgcttcgagccatattct

SEQ ID NO: 678 - DNA, 411 bp, Nicotiana tabacum
aaaatgttcttgattacctccagaatgaatatcccgacatggatgtcatcggcatatctgggaacttttgctcggacaagaagccagcagcagttaactggattgaggggagaggaaagtctgtagtttgtgaggcaattatcacggaagaggtggtgaagaaagttcttaaaactgaggttgctgctcttgtggagctgaacatgcttaaaaatcttactggctctgcgatggctggtgcacttggtggtttcaatgcccacgccagcaatatcgtctcagctgtgtatatagcaactggtcaggacccagctcagaacatagagagctctcattgtatcactatgatggaggctataaatgatggcaaggacctccatgtttctgttacaatgccttccattgaggttg

SEQ ID NO: 679 - DNA, 232 bp, Nicotiana tabacum
ttggactctggacgcggagattacctctcttcttcagtaaagcagtatattcaatacctcctcaaggtgaatatggaggtggcatatggaacagaatggcctaaagaagagaaagtaaagcgcagggagatggtttcttctgaagctcgttatatatttgtctatgaaaccgtaaatgcggatgccaacattatgttcaaattatcaaagaaaggaaggagtaatgcagacg

SEQ ID NO: 680 - DNA, 506 bp, Nicotiana tabacum
accagtcttcgataaacttgaagctgagctagctaaagcttgcatgtcattacctgcaacaaagggttttgagtttggaagtggcttcggaggcacattcatgactggtagcgagcataatgacgaattctatatggatgagcatggccgaatcaggacaagaaccaacagatctggtggtatccagggcggtatatcaaatggagaagttatcaatatgaaaatagctttcaagccaacttcaactattgctaggaagcagcaaactgtgacgcgagataaacatgacacagaactcattgctaggggtcgccatgatccttgtgtagttccccgagctgttccaatggttgaagcaatggtagccctggcgcttgtggatcagctaatggctcattatgcacagtgtatgctgttcccaattaatcctgcattgcaggaacctttgcagtcatcaacacccgagtcagctgaggttaccctctgaatggagctgagcagctttt

SEQ ID NO: 681 - DNA, 296 bp, Nicotiana tabacum
ggatcctacaattataggggttttgacctagggaatcacttcaatgaatatgctggctatgactgtgattacagcttatatccaagtaaggatgagcagtttcgtttcttcaggcactatttggatcctgaccaatcgaatgagttatctgagaaggaccttgaagctttatatgctgagaccagtagttacatgcttgcttcacacctatactgggctctctgggctttgatccaggcgaaaatgtcacccattgattttgattacatcagttatttcttcctgcgctataatga

SEQ ID NO: 682 - DNA, 447 bp, Nicotiana tabacum
ttacctccggcaatcctaccgattacgatcttcattactcgcagtttagcttagaaagtttgaacagagaggagaagctgatgggattaggttcaaggaatttctttttgtgcccaaagaagtcaaatgccgaaagtgctggtgctgtaacgacgtcgtcttctagttctagctgtgcaaagcaagctgatacggctactgctagtgctaccaagatagccttgccttggcttaaattcatggatttcttgcgctagaagttcgagattattgtatacaacatattatactatagatgaaagttagggaggtgattaattaagatttaagaccacctcaaaatttagaataatgtttacctattagatttaaaatctttatatgtttgcacattacatgcctgtttaaggtcaactattttcctatcgaccttgatgttgcagtatg

SEQ ID NO: 683 - DNA, 468 bp, Nicotiana tabacum
atgatctcactattggagtcgagtttggggctcgtatggtcaccattgacagccggccaattaaactccaaatttgggacactgctgggcaggaatctttcagatccatcaccaggtcatattacagaggagctgctggcgcacttctggtttatgacatcaccaggagagagacttttaatcatctagccagctggcttgaagatgctaggcagcacgcaaatccaaatatgaccataatgctagtaggtaataagagtgatctgtcacaccgtagagctgtcagtaaagaggagggagaacaatttgcaaaagaaaatgggcttttgtttcttgaggcatccgctagaacagctcagaatgttgaggaggcctttatacagactgctgctaagattcttcaaaagatccaagaaggtgtttttgatgtctccaacgagtcatctggaatcaaggttgggtatggac

SEQ ID NO: 684 - DNA, 230 bp, Nicotiana tabacum
ttggtattgtggagatcatagatggaaaggatctactgaatgagagagcaaatacagaactccgatacctaaagaagaaacccgagtcatggagattggcttgccaaactatagttggaaataaggaaaactctggaaaggtagtggtgcagaggttgcctcaatggaagaagtgaccgcatatgcatacattgaacaggtaattcagcaagaaatagaagaatatacat

SEQ ID NO: 685 - DNA, 532 bp, Nicotiana tabacum
catggacttatggtgcaaggctaccacccagtcataaaggcattatcaaaagacatcgatattcgtttaagtcacagggtcaagaggattacaaatgggtataacaaggtgatggttacagttgaggatgggaggaattttgtcgcggatgctgctattataactgtgcctctaggtgttcttaaagccaacttgattgagtttgaaccaaaattgccagaatggaagcaatctgcaatagcagatcttggtgtaggcaatgaaaacaagattgcattacgatttgataacgtattttggccgaacgtggaattgttaggtgttgttgcacctagttcatatgcttgtggttattttcttaacctccacaaggcaacaggacatccggtccttgtctatatggctgctggaagacttgcttgtgatcttgagaaattatcagacgaatctgctgctgagtttgcaatgctgcagctgaagaagatgttccccgatgctactaagcctgttcagtatctggtatctcgctggg

SEQ ID NO: 686 - DNA, 232 bp, Nicotiana tabacum
ttcaaggcggccaccgcggctcttccgccacgatgacttagccaacgacacgtgcccttgggggccaaaggcccctactgcgggtcggcaagcggacggcgggcgcatgcgtcgcttctagcccggattctgacttagaggcgttcagtcataatccagcgcacggtagcttcgcgccactggcttttcaaccaagcgcgatgaccaattgtgcgaatcaacggttcctctc

SEQ ID NO: 687 - DNA, 324 bp, Nicotiana tabacum
gatcgggaaagagctcaagctcggactggtaaaggcaagactaagggaaaagatgatggtttgactcctgagcagcgccgtgagagggatgcaaaagctctgcaagagaagactgcaaagaagacgccaaaagatgcaggaggtagcaatgctggaactaaagacaccaagaagtaatgagctgctgtttgctcaatgtggtttgttagctttctggagatttatagatttaattatttcttaatcccggcgtttcgtgtgttcaatgtatcatcagttctatgttgtgttgcagtatgacattgagctgaatcttagtatgtt

SEQ ID NO: 688 - DNA, 300 bp, Nicotiana tabacum
  modified_base (298)..(300): a, c, g or t
tggtgagacaattaatgacaaagataggtgcccacagtgtaagggagagaaggttgtgcaggagaagaaggtgttggaagttcacgtggagaagggtatgcagaatgggcagaagataacattcccaggcgaggcagatgaagcgccggaaactattactggagacatagtctttatcttgcaacagaaggaacatcctaagttcaagcgaaagggagatgatctttttgttgagcacacattgaccttgaccgaggccctatgtggtttccagttcatcttgactcacctagacaannn

SEQ ID NO: 689 - DNA, 432 bp, Nicotiana tabacum
tgcatggttctatttgctgggattgccgctgaagctcttatttatggagaggctgaaggtggagaaaatgatgaaaatctcttccgaagcatctgtattcttctagaacccccactctctgtggcacagatgtcaaatcaagcaaggtggtcggttctgcaatcttataatctgctgaaatggcacacacatgcacatcgagctgcggtaaaagctattgaaagtggatgcagtctgagtgtggtcattaaaaaaattgaggaagtcatgtctatgaaaaaatgaagctggaagagaagaatgatagatagatatttgtagaagagggtttgttgaggtgttttaacttgtccaggcatatttactgctatgaaaagcctcaactggagctagtagaaaaggatcgaacattctttgggcccgtggagatgt

SEQ ID NO: 690 - DNA, 249 bp, Nicotiana tabacum
aggcggcattggtggcttatgtcgccggaggtggtggtggatatgagcggattgtggcggcggctttggtggagaaggaaggtgcaaaggtaaggcaagaggatacggcaaagctatttttcaagatggtttctcctaaatgtgacttgagggtgttccattgctcatttgctaagaatggatgtataaaggattgaaatttatgtgagtttaaccaatatttgttcattagtagtctgcattggcttt

SEQ ID NO: 691 - DNA, 162 bp, Nicotiana tabacum
acaggaaagaaagagcaggagttggttctgatgaatcgacaagtgagacctattaaagtccacttgcccattaataaaccaaccccacatagcttatgtttggttatgtgaggcatgtattaaaatttctcacgggtagtcaacttgggtccatctaatggt

SEQ ID NO: 692 - DNA, 361 bp, Nicotiana tabacum
cttgatgctacacgtggcgttgggtggggcaaggaccttcgtcccccctttatgcacggcccaaaggttgtcgaagctgtcgagtccgagtgagacccttttcttaggtttgtctttccagttaaaagtataacttcagagcttgttgggctaccaacagtgcatcactggtgaatttgagtgtatcactgtttctgtcattcgctgctctaagacctgttttatagtttcctgtcttgtgaaagatgccaatggtttgcattggctttaacttcagccttttgctcttttgggggaacatttaattcatactggaaataaagaagaaatgttcatgctctttccttgttggtctcggctt

SEQ ID NO: 693 - DNA, 337 bp, Nicotiana tabacum
ctccttcactgggaaagttgaaaaatcttgttttcctgcgtctgaatgataaccagctaactggaccaatcccaagagaacattctagtgtttctagcctgaaagttgtggatgtctcaaataacaatttgtgtggaacaattcctacttctggtccatttgagcatattccactgaacaactttgagcacaatcctcgacttgaaggtccggagttgttgggactcgctagctatgacaccaattgctcttaggaaagttgatgaataggctgagaagaacagccgctttttgtggaagttcacataaatcccttccctgaatgttgtttatgatt

SEQ ID NO: 694 - DNA, 462 bp, Nicotiana tabacum
cttctttggatccatttttgtggattaatttgttgattcaaagttttcctatttataactgggttttcgtttaattattttcctaattaatcatcgagcctctaattaatggagcctcgtgttggtaataagtttcgtttgggccggaaaatcggtagcggctcctttggtgagatctacctcgggactaatgttcagactaatgaagaggttggagttaagctggaaaatgtgaagacaaagcatcctcaactattatatgaatcaaagttgtataaaatactacaaggaggaactggaattcccaatttgaaatggtttggagtcgaaggagattataatgtccttgtgatggatttactgggacctagtcttgaagatctcttcaatttctgcagtaggaagctgtccttaaagactgttcttatgcttgctgaccagatgataaatcgagttgaattt

SEQ ID NO: 695 - DNA, 254 bp, Nicotiana tabacum
aaagcaaagcaatgaaagattgcttttttacatagataataaaatgctgaaattcctgaaaccataatactagcaaattctaacagtaaaaatatttgcacatggactaatcaggaaccagtctcaatgcgcatttgttttataacggtggcgttaaggccagcttgcgcatgcttcaactattctgccgaaatctgctacctccaatcagcacagtctcaacgtgcacttgaaccaatgcctatacacttgtt

SEQ ID NO: 696 - DNA, 358 bp, Nicotiana tabacum
aagtcccccaagtgttattaaagcttactacaaacagtatgaaaaagatttttcaaattttctaaagtatcgttcagaagaattgatgaaaggtgggaagatggttttaacatttttaggaagagaaagtgaggatcctactagcaaagaatgctgctatatttgggagcttttagccatggccctcaatgagttggttgtagagggactgatagaagaagagaaagtggactcattcaacattcctcaatatacaccatcaccagcagatgtgaaatacgtagttgagaaggagggatcattcacaattaatcaattggaagctactaggagtccattggaatgctcgtaatgacaa

SEQ ID NO: 697 - DNA, 361 bp, Nicotiana tabacum
tgctcaacttgggatggtaacaagcctttggcatggaggaggaagtatggttggactgcattttgtggccctgttggacctcgtggccgagactcttgtggcaaatgcttaagggtgacaaatacaggcacaggagctcagaccacagtgagaatcgtggatcaatgcagcaatggcggactagacttggacgttaacgttttccggcagctcgacacagacggaagagggaatcaacgtggccaccttattgtgaacaacgagtttgttaattgtggtgacaaaatgaatgttctggtatccccagttgacaaggaataagaagcaaaatatggccatgtttagtctttgacggcccaaa

SEQ ID NO: 698 - DNA, 304 bp, Nicotiana tabacum
cggcctgctgcaagtcctacattcgttccatcaatgcattccaattctcacaagaaggtgcttgaaatgagaaccaaggacattcccgagaacaacgccacagccaggactcaaatcccagcaacaatcaccgaacatgagttcagcaaatcctcagtggaggggtagatgtaaagggaagggaaaaaagaagcggagaatagctttacctagtcaatagtttttttgtgtcatctctgcatttctcatttcagttaatgttatttacttgctgttttttcattgctttgttcattggttcttt

SEQ ID NO: 699 - DNA, 610 bp, Nicotiana tabacum
attgctcgttttggacacggatcagccaaactagcccgtcaagcacaaagcaaagagaaaacactggctaagatggagcgtggagggcttacagagaaggtggtgaaggacaaggtcctggtcttccggtttcctgatgttggcaaacttccacctcctgttctgcagtttgtggaagtgacatttggctacacacctgataatctcatttacaagagccttgattttggtgtagaccttgattcaagggtagcactggtgggacctaacggagctggaaagagcacgctgcttaagctgatgacaggggatttagttccccttgatggcatggttaggcggcataatcacctgcggattgcacagttccaccagcatttggctgagaagcttgacatggaaatgtctgctctccaatatatgataaaagggtatcctggaaatgaggaggagaagatgagagcagcaattgggaggtttggtcttactggtaaagctcaagttatgcctatgaagaacttgtcagatggtcaacgaagcagggtagtattcgggtggttagcttttaggcaacctcacatgctgctgttggatgagccgaccaaccatc

SEQ ID NO: 700 - DNA, 414 bp, Nicotiana tabacum
tcagaatactggtgatattgaggaccaggtgatagcagtgaacacggtgcaacatgaaaactccggaaagttttacataacaaaattcctgggatctcctgaaggagcagagaatgaaattagtttctttaacaaactagaccatgagttcaacaaggttaataccttctataaggacaaggtggatgaagtcatgagggaagtaactttgctgaataagcagatggatgcgttgattgctttacgtatcaaggtgatggatcctggtttcgatgcttttggctcccttcaacgtctttcatttgacattaacaattcaacgccctcgaggagttacatctcctctcagaatgacaactgtagatacagatcatatgactgtcggcacgtgtttcgacccaagttacagcagac

SEQ ID NO: 701 - DNA, 264 bp, Nicotiana tabacum
gcaactgtaaaacaagtgtataggcattggttcaagtgcacgttgagactgtgctgatcggaggtagcagatttcggcagaatagttgaagcatgcgcaagctggccttaacgccaccgttataaaacaaatgcgcattgagactggttcctgattagtccatgtgcaaatatttttactgttagaatttgctagtattatggtttcaggaatttcagcattttattatctatgtaaaaaagcaatctttcattgctttgcttt

SEQ ID NO: 702 - DNA, 286 bp, Nicotiana tabacum
agattaggagcaaacaaatattcagagaggcaggcaattgggacggcagcgcagagtgacaaggattataaggagccaccaccagcgccactgtttgaggcaggagaattgacgtcttggtcattctatcgtgctggaattgctgagtttatggccactttcctcttcctttacatcactatcttaacagtgatgggtgtttcaaagtctgaatccaaatgctccactgttggtattcaaggcattgcttgggcttttgggggcatgatttttgcccttgtttact

SEQ ID NO: 703 - DNA, 386 bp, Nicotiana tabacum
aaaaaaatgttaaagatttctggccagatgttaagattaagtatattgctgttgggaatgaaatcagccctgtcacaggcacatcttaccttacctcatttcttactcctgccatggtaaatatttacaaagcaattggtgaagctggtttaggaaacaacatcaaggtctcaacttctgtagacatgaccttgattggaaactcttatccaccatcacagggttcgtttaggaacgatgctaggtggtttactgatccaattgttgggttcttaaggggcacacgtgcacctttactcgttaacatttacccctatttcagctattctggtaatccagggcagatttctctcccctattctctttttacagcaccaaatgtggta

SEQ ID NO: 704 - DNA, 256 bp, Nicotiana tabacum
agaggagatagtgctttttgcagcctagactgtagagaaaagcagatgaaacaagacgaaagaaaagagaaattgccgaaggttgcaacaaggaaaaaagttactaactcagccgccatagccaccgtgggaagtggaacaggatccgacgctccacctcaggccagaccgtaagccggccgccgtatagattcttactagctataatcacgttgttgaaattcgataatgaacaaatattccagctgatgtttaa

SEQ ID NO: 705 - DNA, 283 bp, Nicotiana tabacum
ggttgcaatgtttgtaacaagaaggtgtctaaggaaggttggttatattatagcaaggatactggctatattgcacatattaagtgtgctaaaggtgctaaagttggggtttcttggattaaagagagacttaatatgcttaaagttaagtagaagaaattaagtatgtgagatgatatatatatctgcttgatcaagtgcttgaaaatatataatgtagggattatgcatgtcgttaaaataaggtatcttgcactggcagatatgaaataagtccaggatt

SEQ ID NO: 706 - DNA, 201 bp, Nicotiana tabacum
aatgatggttataagattgatctggcgtttgatgatgctgatactatggaagaagaaacacttgcagcaatcattgggcgtcggaaactgcagggtgatgattctataattcaagagaagattattctggaagctgctgataaactgatacttattataaaggaaaaacaattcaaaagcagtgtagatggttcaattcca

SEQ ID NO: 707 - DNA, 331 bp, Nicotiana tabacum
ggtccgatgctcttagatatgatcaaagacgtggagatggcaatctcttgtcgaaagggacgaacaggcactgctgcaggggatgttgcttttcctaaagggaaagaaaacttggcatctgtcctcaaacgctataaacgtcgactatctaataagccagtaggaaaccaggaggccggtggagctggaccgcgcaaagtaatgtcaccttcagcagcccctttcagcttgtaacacttgtttcttggttcatagcagctgaccggtgattaccacttttagacttgtgcttagttgctatgaatttgctcctctctctctctctctctct

SEQ ID NO: 708 - DNA, 278 bp, Nicotiana tabacum
aatcctggacttatttcatatctgccagtgcaagataccttattttaacgacatgcataatccctacattatatattttcaagcacttgatcaagcagatatatatatcatctcacatacttaatttcttctacttaactttaagcatattaagtctctctttaatccaagaaaccccaactttggcacctttagcacacttaatatgtgcaatatagccagtatccttgctataatataaccaaccttccttagacaccttcttgttacaaacattg

SEQ ID NO: 709 - DNA, 328 bp, Nicotiana tabacum
tctagtcaatcaggagagctaggttcatctactcaagcagttgatggaataattggttttggacaagcaaactcatcccttatttcgcagctagctgtatccggaaaggtgaaaaaagtatttgcacattgcctggacggcagtaatggtggtggcatatttgccattggacaagtagttcagccgaaagtaaagtcaacaccactagtcccaaatgagccacattacaatgttgtcatgaagggaattgaggttaatggtaaagctcttgacatccctacgactatctttgacgcgggatccaatagaggaacaataattgacagtg

SEQ ID NO: 710 - DNA, 208 bp, Nicotiana tabacum
cgattgctccctataacggccctggactcaccgaagaccaacaaaatggcggcgtttggctcgactttaaaattgacggccgtgtgaaatggaaagtagggtctgttacaaccggtcattaccatcttcacgtcacgtgctccgcgtatgttccactcggtgaccaccctgctaacggcggaatcgtcgtcggaaacaacgccgttaa

SEQ ID NO: 711 - DNA, 587 bp, Nicotiana tabacum
ttgttttgagtgcctatttattttctatcgggatctatggattgatcacaagtcgaaatatggttagagcccttatgtgtcttgaacttatattgaatgcggttaatataaattttgtaacattttctgattttttcgataatcgtcaattaaaaggagacattttctcaatttttgttatagctattgcagccgctgaagcagccattggactggctattgtttcatcaatttaccgtaacagaaaatcaactcgtatcaaccaatcaaatttgttgaataattagtattaatcatctagattctaatattgataaatcgattttaattagcatgtttgctacgtaaggtgtgatcttgtttgcaaaacataagaaatcaaagtattttggccctctctcatatctcataaaccaatccagaagggggttgattagaaaattatgataactcattgatccatctggtatataaatatatgattatatgattcgtttctaagtttactagatcgaaaattcctaacattcaaaaacgtatagacccaatgtcacattcagtaaagatttatgatacgtgtataagat

SEQ ID NO: 712 - DNA, 341 bp, Nicotiana tabacum
caaagagtgtggtaattttgcctatgggatatgcccgcgttcacaaggaactccagacgatcccatatgcaccacttgttgcgcaggctacaagggctgcaactattatagcgctaacggaacttttatttgtgaaggatcgtctgaccccaaaaatccaaacgtttgtccccagttttgtgatccagatattgcctattcaaaatgcccgcgttcagaaggagagacgataattaatcccaccggatgcactacctgttgcacgggatacaaaggttgctactacttcggtcaggatggcgagtttgtttgtgaaggagagagtgatgaacccaagagtt

SEQ ID NO: 713 - DNA, 227 bp, Nicotiana tabacum
cttggctcatcgatacattatacaactacattgcatacaaggagccactacgaatagacaatgcagaaggactaagtttctctttgcttgttttctcctccacttccgtagcatgtattggtgttttggtgtttaggcggcttactcttggtgctgagcttggcgggccgaaagtttcggcatgggtaacttgcatattcttcatgtttttgtggctcatatttgtt

SEQ ID NO: 714 - DNA, 356 bp, Nicotiana tabacum
aaccacagcttccctagtggttatcaccatgcgtctcgtgcccctgaaactcacaagaaagtccactttgtggagtgtgacaaagccactgaagttgataggaatggaaaatatgaagtcacagaggaaaaggttgataatgaagctgatagcttcattcagaggaaacacaagacctttgagcttgcaaagatggatacttttaaggtctattgatagactatttgcatggcagacaatacatttccctctgactgttaggtcattggttgaatcactagtataataaaaaaaattgtctgtcgtatacacttgaccgtagactgtctttacagttgtatgcgagtagttgatat

SEQ ID NO: 715 - DNA, 576 bp, Nicotiana tabacum
caatgctactagtgttgatgttgaagaacacctttataggcttgctacagatgctggcattactgttgttacatcctcacagcgccctgctttaattccattccattctgtggaattacggttgattgatggtgaaggcaagtgggagctccgttcaattaagaccgatgagcgggaaggcgaaccaaaatgacattccttttagccggtagttggcaaaggtctattaaattacacaacaattgtgactatgattatgtattccaatgttgtgaaaacgttcttggacgggtatagaggcagtaatgaattgattatgcatgtgttacattgcagttagattgaagctaggaaactatacagttagggtatacaaatattaaattgtttcttgtaatatttcatatagcaaaacgagtttctgtataggcagttgttctgattaagcctttgtcccgtcgttgtaaaaggtttatacctgatcagccccccccatgaataaaaatggcaggtagaattgaggctgatggtttttattctacatttaacattatatataatattaatcagcagcca

SEQ ID NO: 716 - DNA, 393 bp, Nicotiana tabacum
attacctacgatagaaaataactatcactaagcataaagcttagtgacgtataaactttgggcttggagtccttaaattctccaattccccttttctgtcatagttagctcaatttaacataatttaaaataagttaacaaatatatcaaacatatcaaatattaaactttaaagcgtttccaaatattaataagaatattcaagagtctagaaagcatatactatcaatccaagagagtttaccaaatattcatttttcgcccaatatgtatgtcatgccatcacactaagcataatcaaatatcaagatggaccgaagccccaaatcaagtagggtcaaaactcaatagtcaagagaatcaagaaccatattaaaaatggcttcccagttc

SEQ ID NO: 717 - DNA, 487 bp, Nicotiana tabacum
ggaattagattggttgggacgacaccgaattgcagtagggatagctgctggacttgagtatctccatataaaccacagtcaatgcataattcacagagatctaaagccagcaaatgtccttcttgacggtgatatggaagctcgaattgctgattttggacttgcaaaagcacttccagatgcccatacacatattacgacttcaaatgttgcaggaactgtgggatatatagcaccagaataccatcagacactgaagtttacagataagtgtgatatatacagctttggtgtggtgttggcagtgctggttataggaaagcttccatcagatgaatttttccagcacacgcctgagatgagtttagtgaagtggctgagaaatgtaatgacttctgaggatccaaaaagggcaattgatccaaagctgataggaactggatttgaggagcaaatgcttttggttctcaagatagcttgcttttgt

SEQ ID NO: 718 - DNA, 236 bp, Nicotiana tabacum
ggctattacctcatctggtctgaagaaaggtgaattattcttagccgatgttaacactcagctgaagaacaaaaatgttaccactgatgtaaaagtggacaccaattccaatgtctacactaccatcactgttgatgaacctgcaccgggactcaagacaatcgtcagcttcgtattaccagatcagagatctggaaaggtagagctccaatatttgcatgagtatgctgggatca

SEQ ID NO: 719 - DNA, 416 bp, Nicotiana tabacum
ctctagctctaaatgcaagaatggcaatagcagcaatatttccagcaagtcagaagagttcaaaaactgcatctttgacattctcagagatatatggaggagtgatcatgaacaatatcatgggcatgacaacacttttggcagctgtgtttataaaggacctaagatgggattattcagcagaagtgctaatagttttggtggtttgctctgtagttggacttcttgcatttttcaccactacatatccactttggacttgcctcttagcattttctctataccctttctctgtgttgctcttttaccttcttgaatgtgtatttggttgggcctaagtggtaatcataataccaccaatacaaccctagtccataccaatcctctcagctcgaaaggaaaaataaataagaggg

SEQ ID NO: 720 - DNA, 234 bp, Nicotiana tabacum
cttttaaccatcgctatgtcaaatctaaccctcgagaagttgaaaatgcgacgtggatgttaacagttttcaattgttttggtcagtgcttctgtctccattttgaagcctttcagctcggaacagctcctgtttacatggcatttcttcgttttatgggagatgagatagaggctcgaaactatagctacagcttggaagttgggggtaatggaagaaaacttacatgggaag

SEQ ID NO: 721 - DNA, 290 bp, Nicotiana tabacum
ggcggcgatggcgacggtgacggcggcggggaaagtgaacggagtttcaaaggagatgcattacagaggtgtacggaaaaggccgtgggggagatatgcggcggaaattagagatccagggaaaaagagccgtgtttggcttggcacttttgatacggcggaggacgcggccagagcttacgatacggcggcgagggaattccgcggagctaaagcaaagacgaattttccgattatagagccggagaatgtgaaattggctaatagaaattgtagtccgagccaaagca

SEQ ID NO: 722 - DNA, 371 bp, Nicotiana tabacum
tggaaatcagaatcaaacgagcttttacccttctgttccacacgagatttctgttctcgttgagctcatcttaggacacctgcgttatcttttaacagatgtgccgccccagccaaactccccacctgacaatgtcttccgcccggatcggcctgcaagcaagccttgggtccaaaaagaggggcagtgccccgcttccgattcacggaataagtaaaataacgttaaaagtagtgatatttcactttcgcctttcggctcccacttatactacacctctcaagtcatttcacaaagtcggactagagtcaagctcaacagggtcttctttccccgctgattccgccaagcccgttcccttggctgtggta

SEQ ID NO: 723 - DNA, 402 bp, Nicotiana tabacum
tgcagcttatggaatgcagatgagtgggctacacaaggaggtagagtcaagacagattggacacatgctcctttcactgcatattacagaaatttcaatattgatggctgcgcagtcacatccggcgcctcttcgtgtaagtccactgattcagcaaacaatgctaggccatggcaaaatcaagaacttgatgctaagggcaggaataggctacgatgggtgcagagcagacacatggtttacaactattgtgctgattctaagaggtttcctcaaggcttttctcatgagtgcaagcgttcgaggttcctctaattaagttgctggagcaaggaaattgtggcactgcctctgctatttattaagattgattcttctcatatttgtgaataatgaatatat

SEQ ID NO: 724 - DNA, 367 bp, Nicotiana tabacum
cgtgggagagacaaggattaccgtcgtcggagcagaagccgcagcccagattaccgcagagatcgcgagagaggtaaatatgatgaggagaggcgcagccgaagccggtctcatagaagtgtgtcccctgctcgccgtagcctcagtcctcggaggagcccttctccacgtagaacaaccccttctagggatgctagtccagatggacgtaatcacaaagaccggtctccaactccaaaaagtgtctcaccgcggggtagacgtggtggttctcgcagccccttgccgcattctgatgctgatgattaaggagcaaaggagaaggccacgaatgtaatctggtttaggtcgctgttgcgtatcaaga

SEQ ID NO: 725 - DNA, 324 bp, Nicotiana tabacum
tacggcaaactagaagagaaaggcatcggaaaattcgtcggaaaagcagagacttatctccacaaatatgaaacttctcattccaccaccacaaccaccaccactaccggaacaaccaccacctccacgactgaacacacgcagtcctcggcgcatacagagggaaaacatgaacaatccggaagtggatatggcgagtatattaaaatggctgaaggaattttcaagaaacattccgatggcacccactcatcggaatccggcggaggtaaaaaaggagagtatcttaaaatggctggagatttcttgaagaagcattgactt

SEQ ID NO: 726 - DNA, 459 bp, Nicotiana tabacum
  modified_base (106)..(106): a, c, g or t
ttctcactgtatatgaatgctttggagtattttaaaacacatttgaagtatgagaagaatcccaagattaaggaagcgattacgcagaagtttgtggagtatttgnggagggctgaggagattcgtgctgttctagacgagggaggaggtgggccaccagcatccaatggagatgctgctgttgcgtctcgtgcaaagtcaaagccaaagaatggaggagcagagggtgatgatgcagagaatgtaaagttaagagctggacttaattccgctattataagggaaaagcctaacgtgaagtggaacgacgtagcagggcttgagagtgccaagcaggcattacaggaggctgttatactgccggttaagtttcctcagtttttcactggcaagcgtcgaccgtggagagcctttttgttatatggcccgcttggaacaggaaagtcatacctagcaaaa

SEQ ID NO: 727 - DNA, 276 bp, Nicotiana tabacum
tactcctgaaaatatgttttatatggatgaggaggcgctattcttcatgcctggattactagtgaatatggcagaaggactaatgttacctccacctcagtgttcacaaattggagatcatatggaagctgatgttgacatgcctttgtggagttattctatctaagtataactctggttatcacttagtattgggtgatattccctataagtacagttacttcaattaagatttcggaggttttggtaaatttcgtactcatgaatatttggagg

SEQ ID NO: 728 - DNA, 461 bp, Nicotiana tabacum
tactactgctactactacttcagctgatgatcatagcgctggatcaaagaaaagatcaaaagctgaaaacaatgaaatattgaaatcagttcaaggagagagtagctcaagtgatgaagacaactcttgtacaaagaaaccaagagaagagcacattaaaactaagacaactagagtttatgtgagaactgaagcatctgatacttctcttattgtgaaggatggatatcaatggaggaaatatggtcagaaagtaacaagagacaacccatctccaagagcttatttcaagtgttcttttgctcctacctgcctcgtcaaaaagaaggtgcaacgaagcgtagaagatcagtctattctggtggcaacatatgaaggagaacacaaccattcacatccctctaaaacggatgctgcaaacgccgttacaacttccccttgtaaccgtttaaacgggaaga

SEQ ID NO: 729 - DNA, 353 bp, Nicotiana tabacum
cttggatattgtttgtggacgtttatcagaaagcagttcaagtgatgaagagtcttgttgcaagaaacctagagaagagcacataaaaactaaggtttctgtcgtttctatgaggacagaagcatctgatacctctcttattgtaaaggatggttatcaatggaggaaatatggtcagaaagtaactagagacaatccttctccaagagcttacttcaggtgctcttttgctcctggctgccccgtcaagaaaaaggtgcaaagaagcatagaagatcagtcagttgtggtggcaacatatgaaggagagcataaccatccagtaaacccttcaaaaccagaggctgctgctg

SEQ ID NO: 730 - DNA, 455 bp, Nicotiana tabacum
gaaagtcaagacgtcccctccttcctcttctcgccgctactttccatcgatcaaattttgacttagtaaaagcgatcgaagaagaagatgtttggaaggacaccgaagaagagcgataacacaaagtattatgaaatcttaggagttccgaagagtgcttctcaggatgatctcaaaaaggcttatcgtaaagccgctattaaaaaccatcccgataagggaggcgatcctgaaaagtttaaagagcttgcccaagcttatgaggttttaagtgacccggagaagcgtgagatatatgatcagtatggtgaggacgctctcaaggaaggaatgggtggtggaggtggtggacacgacccatttgacatattccaatcattctttggtggtggaagcccctttggtggtggtggaagcagcagaggtagaagacaaagaaaaggagaggatgttgt

SEQ ID NO: 731 - DNA, 480 bp, Nicotiana tabacum
ggctgctgacttgattcatttatatgcttacacaaagtgttttttagaatacgagaatacaagactgtaacttcacctcctgtatatataagtcctttagacctgggacccaaatatgctgataagctgggccctggtgttcacgagtatcgcaagacatatggcgaaaattattgcttaggacagctgatttattggtataatcaagcaaatgcagatccagataattgccttttcagggcgagcaggggttgcttgtctttacctgaagctggctctttttatgctaaagtccagaagccgtcccgccaacgtgtttacggcccaaggactgtgaagttcatgctatctagaatggagaggcagccccagagaccatggccaaaagaccggatatggtcatataagagtggtcccaaagtatttggcagtcctatgctggatgctattttaaacaaggctccactagaaagggaaatg

SEQ ID NO: 732 - DNA, 201 bp, Nicotiana tabacum
cgttgagaactcgccaccggttatgccggagaactcgccgccggcagtgatgctggacacttcaccattggatctcagcctcggtggatcccgtagtttatttagcaacggtgtgggtagggttttgctccagaaccatcagtttcacggttctccagtcgccggaggaatcgctggatgtattacgccggtgaatcatat

SEQ ID NO: 733 - DNA, 254 bp, Nicotiana tabacum
tgactctcttctctcatcttcgtcaatctctcgtctccttctttcgttctttgggttttacgactgaaaaatggaattctctgaaacaggctatgacattgccactgatgaatgggacaataatattcctgataactgggatgataatattcctgataaatgggacgataatattcttgataccttcaaggtattttcctcagcaactaaacctcagaaaggtggacttcgcttgtttgcagattatgacttta

SEQ ID NO: 734 - DNA, 444 bp, Nicotiana tabacum
tctcaaacccgtagccattgagcttagcctccctcaaacaggtccaagttcacggtcaaaacgtgttgtcacaccacctgttgatgccactggtaattggatgtggcaactggccaaagcacatgtctgttctaatgacgctggcgtacaccaactcgtcaaccactggttgcgtacacatgcgtgcttggaaccatttatattggcggcacataggcaattaagtgcgatgcatcccatttataagcttctggatccgcatatgagatacacactagaaattaatgcattggctcgccagagcttgatcagtgctgatggtgtaatcgaggcttgttttactcctggtcgttattgcatggagatgagtgctgctgcctacaagaattttggcgttttgatttggaaggcctcccagctgaccttatcagaagagggatggca

SEQ ID NO: 735 - DNA, 444 bp, Nicotiana tabacum
  modified_base (5)..(5): a, c, g or t
  modified_base (426)..(427): a, c, g or t
  modified_base (437)..(437): a, c, g or t
  modified_base (439)..(440): a, c, g or t
  modified_base (442)..(444): a, c, g or t
tcctntcttctcgctcccttctttcgttgtctgaatcactgcttttccttctatcttcctccagctcagcaagctcagccaagctaccattcaacaacagctcgagcgatttccttttcgaattcctcaaccacttagggtaagaagcaatcacttcacatggcctgttttcacttgaatcacaagcattaacatccgccgaagcaatcaaatcaagaatcttaacgaccatcaaatcgacgaattcagaatccaccagctgcagcagcagtgaagagcagtttgcaccaatcagaatccaacaagcccatgttacaatcaactttcccagttccaaataaataaccatcaaaaccatcagatccctgcccgggcggccgcatcagaaatcaaattcccgcggccgcacatggcggccgaggagcnnagcgacgtcngnnannn

SEQ ID NO: 736 - DNA, 298 bp, Nicotiana tabacum
catactccaatagtgaacttgatgtcaaagcagcgcaaagatacattgacttcatgtacggatggttcatggatccataggtgtatggaaataatccttcaattatgcgtacaatgcgtgggatgaaaggctaccgaatttgacagcggagcaagctaagatgatgaaagggtccttggacttcataggactaaattactacacctcaaattatgcagctcatctccctgccgcaaacaattttaatgtcagcagtgcaacagaccctcatgtacacgttacaggtgaaagagatgga

SEQ ID NO: 737 - DNA, 366 bp, Nicotiana tabacum
cttatcaccggcagtggaaatcgacggtggccggcgatggcattggcaccggggctatcacggaagctgaagaaagtgctggaaactcgaacagacacgccggatctgctcgcatctctgaatactctctccacattctacaccgaaaacacacctcattctcgccgtaacctccgatccactattgagaagcgttctctatctataaatgaagagttccttctttcctccactgctgctcagaaggcgttggatcgagtcgaagaagaagtcaattcgatcgtggaatgctgtgacaaaattgcactggctttaagcagttgcaatgccacgacaggtgatattattagtacctgcccgggcgga

SEQ ID NO: 738 - DNA, 305 bp, Nicotiana tabacum
catatatagcaatacaagaaagatgcaaggccagtggatagccgcaagagacctttcaattacatgggtggacaatcctcagtactggacatggaaaactgttgatcctaatattgaagtggcggagcttcgtagggtagcttggcttgacatttatggaaagatcgagacaaaaaatcttattcgaaagactagttatgctgtatatttagtgttcaagttaacagataaccctcgtgaacttgaacgagccacagcatcgctacgatttgtgaacgaagtggcggagggcgctggcattgagg

SEQ ID NO: 739 - DNA, 422 bp, Nicotiana tabacum
tgcaatagatgatgatagaccttcatctaacaaagacatggagaaaactttatcacaaacttgtgatgcagatgtagctaaggacgatggcccggtcagtgatgtgtcgaaaacaactggtgatcaagaaaattttaggcctaccggtgaagaccagacagaggcaccagttgttgacttgaccaagcgtttatcttgcaaatggacaagtggagttggtccccgcattggctgtgttagagactatcccattgatcttcaatctcaggcccttgaaaaagttaatctttctccgagggttacattgtctcagcccaagaattgttatccaatcccttcaccacgaccgagcccaaaaattcgtgtctcgcctaggctcgcattcatgggacttccaagcccaagagtttctgttactagca

SEQ ID NO: 740 - DNA, 541 bp, Nicotiana tabacum
catctttcgattctgtgctattccacaggtcatggcaattgggacattagctatgtgctacgacaacattgaagtcttcagaggagtggtaaaaatgagacgtggtctgactgctaaggtcattgaccggaccaggactatggcagatgtatatggtgctttttttgacttttcttgtatgctgaaatccgaggttaataataatgatccaaatgcaacaaaaactctgaagaggcttgacgtgatcctgaaaacttgcagagattcgggaaccttgaacaaaaggaaatcatacataatcaggagcgagcctaattacagtccagttctgattgtcgtcattttcatcatactggctattattcttgcacagctatctggaaaccgatcttagacgatattttgggttacaaaaaagaagtctggtcaaggaagacagcacaagctcttggccaattatgtgattagtgcagattttgatgtttgtaattctatgttcattaagtgatagttgcaccttttaacctgacaaggtaattac

SEQ ID NO: 741 - DNA, 540 bp, Nicotiana tabacum
gaaaacaacaatggctaccaatgctaccaagccttccgtttaccttcaagacatggaggaagtcaaaaaagtattcgcgcgcttcgacgccaacggcgacggcatgatttccggcgacgagctttccggcgtattgaaagccttaggatccgacacttcgccggacgaagttgaacgtatgatggctgaaattgataccgacagagacggctgcattaacctacaggaatttgctgatttttgcaaaagtgacggttccgttgacggcggtgctaaggaactcaaggaagcgtttgatctttacgatcaggaccataacggcttgatttctgctgcggagcttcaccagatcctcaaccgtttgggccagaattgtaccgttcaggattgtactagaatgatcacctccgttgatgctgacggtgacggtaacgttagctttgaggagtttaagcagatgatgtgtaataattgtaaaagataagcgatgcctttttttctcatcctttttccgttatttgagtggctgataacggtgag

SEQ ID NO: 742 - DNA, 296 bp, Nicotiana tabacum
attgcatccaggtccagttagtttattgcattggagtggtaaaggtaaaccttgggttaggcttgatcaagaaaatccttgtcctgttgattttttatgggcaccttatgatttgtatagaccgagccttcatgattcttttgaccaacactagcggagattgtgatgtgacagtgtaaaaattcttttacgcttttagcgtatacgagttatttttttctttttttgtattgtgataattctttgattctttttcctcattgggaagaagtgagacccggagtctgtagtattag

SEQ ID NO: 743 - DNA, 332 bp, Nicotiana tabacum
ctctttattatggtggtgtaggaggagatcacgagtataagggtgtgccgggaacttatttcccgctcagaagaggcggaaaagtaacactttatcaagatgctcatgtacccgaaggcagccttccgaatttgtggcttgaaaatggagtgcagtataagcatggacagtgttggcaggatatgttcaatgcaataaatcaggctcgtcggttgatttacattacaggatggtcagtgtaccacctagttacacttgttagggataatggaaaagctgaggaaagcatgttgggggaaattctcaagaggaaatcccaagaaggtgtgaga

SEQ ID NO: 744 - DNA, 625 bp, Nicotiana tabacum
  modified_base (53)..(53): a, c, g or t
  modified_base (69)..(69): a, c, g or t
tgcagaacttcatcactgcaatggactcattgaagttgaacatggttgccatngatcaggtccatcccntgttgtcagagctgtcatcttccctcaataagctatcgattctgccggtggattttgagggaaagacaaagatgagggagtggctttcaaggttgtcgaagatgggggctgcagatgagttgacagaacagcaggctcggcaactccattttgatctggaatcctcatacaattctttcatggcagcattgcccactgctggaacttaattgactatttcaacaggtggtatgtttgtatataagattgttgttgcatttagcaagctcttaacacacatgattctatctttgattggagtgctggtcactatctgagtagaatagccatctatattttgggacttcatacttgttagataattgtaagactggtggtggtacctataagatggaagttgaatcaaaagctgaaacgaaatcagaaatcagagcagcggccaccacgctcccagtcgccatagcgggtgggctcaggacctttagggcctccaatctcaccagtctttttattaatgttatcactgcccccttcgtcattctcgccctcaacttca

SEQ ID NO: 745 - DNA, 365 bp, Nicotiana tabacum
acaattttttgccttccacttacctaacattttttaaactatttgtgtcaaacagtgacagttcaaagtccaaaagattgactaatcttaaagttaaaacaatagttctacagctgaggttgatcatgacaccagtaactaattgagaattttgattaagtccccattttcccctaacccccaacatctttaccaaattatattttagttcacatgatgaataaacttgaccacaacgattttctagttggtctaatacattcaagattcaaaaaagacaaacactttaacccacaaaaagaaacctcatcgctaaattcaaagatgcagaagtttagacttcagattcatatactcccaaaaag

SEQ ID NO: 746 - DNA, 594 bp, Nicotiana tabacum
cagcgtagcagataaagatactgcagcatggacagtcttcacggctattggcagtttggcgatgagctccgaggacaatcaaaagtttcagaggatcatcaatggtcaacggctgctatgaaattggctcagcagataaggtccaagggtgagcggaggaataacctagacctttcaaagggctcatctgaaattaggcccagggataatttagggtttcaggaagataacaagtgggaaagccttaacttctacatgttgaatttggataccaagatgaatgaaaatacgtcgaagagttccattacgaatggcatgtacaacatgaattcagcttatcttaaacccaacgtcaacaacttgggaaatgtgtctttaagcaagttcaacattgggaaccacacaaaggaaagcaacaacaacaataacaacagtgagagtgccaatgggaataatgccactgacaaaaggtttaagactttgcctgctgccgagacacttcccaggaatgaggttctggtggatatatatttgtttgcaacaatgacacgatgcaggaagcctaaaacgccagctgttcggtctacctccaag

SEQ ID NO: 747 - DNA, 400 bp, Nicotiana tabacum
gtggcggctagagcgcatgacgtggcggctattgcattaaggggccgttctgcttgcttgaacttcgcagactctgcttggaagttgcctgttcctgcttcctccgacgccaagaatattcagaaggcggctgccgaggccgccgaggctttccggtcatcggaggccgaaaacatgccggaatacacaggagaagattcaaaggaagtgaacactattcctgaaaatatgttttatatggatgaggaggcgctattctgcatgccgggattacttgcgaatatggcagaaggattaatgttacctccacctcagtgttcccaaattggagatgatcatatggaggctgatatgcctttgtggagttattcaatttaaatatagttctggttatcactta

SEQ ID NO: 748 - DNA, 371 bp, Nicotiana tabacum
tccgccggtgctccgtcttacggtagtgatccgcataaacccccaaaagagaacaaaccgcagtcttacggtggttacccggctccaccaccttcagctccttacggtgatccgaacaaacccccgaaagataataacccacacgcgtcttctccttacggtgggtaccacgcgccagctccttatggggctacgagcccgtttgcatcactagtgccctcggcttttccacctggcaccgatccgaacgtgatagcgtgtttccagctggcggaccaggatgggagtgggttaatcgatgataaggagctgcagaaggcgctttcttcttataatcagagcttcagcttgaggactgttcatctccttat

SEQ ID NO: 749 - DNA, 342 bp, Nicotiana tabacum
gagattgattgggtttccggtatggactgtcgccacgcctcccttggccgtcgaacgttggaagaaattcgtcaaaagagagcagcagagagattaagcaaaacctcttctggacccgatcttaccaatatccctaatgaggttgtggggattaaaagatctgagagtgcaactcgactatcagagaatgatatgagtggtttagtttctcaattgaaacaaattcaaagaaataatgcagaactggatgaagcaaatagagcactggccttaaagcttcagacaaaagaagccgagaacaacatgttgcaaaagcgtcttaatgatctggagcaaaatact

SEQ ID NO: 750 - DNA, 268 bp, Nicotiana tabacum
attttcaagaaacattccgatggcacccactcatcggaatccggcggaggtaaaaaaggagagtatcttaaaatggctggagatttcttgaagaagcattgacttgtactatgtgaattcctttttatcttgtgttttagaatttctttgctgcagttctactattgttatttatcagtggataggtgtgatttgtaatgtgcggcctaggctgcattgccgatgctgctagccaatgaaaataattttgttttaatacgaaaaaaaa

SEQ ID NO: 751 - DNA, 527 bp, Nicotiana tabacum
gctgatgttttcgctttaaaggaaattgggatcgccgattcagttgggatatacaagaaaggctcaaagcctttggttattacaggtaaagctgttaaacagccttttgaagataatacatttgatttcatattttccggtgccggaatgatagataagtcgacgaagccgggcgatttcgcggcggagatttgtcggactctgaaacccgaagggtttttcgtggtccatacaacaggttctaaagatacgtacagtttcaattcattccttcatttgtttaactgttgtacattgattaagcctaggaatattgatggttttgattcaaatactattcgtgagattgttatgaaaagggttgtttttggggatgtatatgttgaagaaaaagtgagcagtgattcgaagaacaaatgtaatgttccggattataaactgaagctgattaaaaaagctgagcctttgattaaagaggaacctaagaaaccatggattacactaaagaagaatgcacagaacataaa

SEQ ID NO: 752 - DNA, 268 bp, Nicotiana tabacum
gctgattgacatctctgaagatggttttgtgtctcttcttactgaaaatggaaacaccgaagacgacctcaggcttcccaccgatgaagccctgctgagccaggttaaaggtggatttgaggaaggaaaggatcttgtgttgtctgtgatgtctgcaatgggtgaagagcagattgccgctgttaaggacattggtaccaagaactagtcgcgcattctgcagcataaataatttgctttagccaagacattttatatcttaatcgtg

SEQ ID NO: 753 - DNA, 250 bp, Nicotiana tabacum
acgttccacacttcgcatctttagcttttggtcttcattcccatctcctggtctccagtgagatgagctctaattccaattggtcttgaattgatccatttttttttgttctagtgttcaatttcttaattcttttctagctctcttatttcattcaattgaaataccaaaattttcgatttcgattattgaaagatgggtgttaaaggatttgttgaaggaggtattgcttctattattgctgggtgta

SEQ ID NO: 754 - DNA, 275 bp, Nicotiana tabacum
aaaagggtgcctgtgatttcaaaaacaagaatttggctattcgggtggaacaatcaagcaaaaggccaaattatctatcaatcaccttcttgtatcaagggggtcaaactgaaatcgttggtattgatgtagctcaggttggatcatctaactggagtttcatgagccgaaatgagggagcagtttgggacacaagcagagtgcccaagggagcattgcaatttaggttggtggtgacagccgggtttgacggcaagtggtattgggctaaggca

SEQ ID NO: 755 - DNA, 224 bp, Nicotiana tabacum
aggatctttttcattgcatggtcccctgacacgtcgagggtgagaagcaagatgatctacgccagttcaaaggacagattcaagagagagcccgacggaattcaggtcgagttgcaagcaaccgacccaactgaaatgggacttgatgttattaagagccgcgccaactagatatcgatggataggtatcagatggaccttataagtgagaaaactcctaatgc

SEQ ID NO: 756 - DNA, 361 bp, Nicotiana tabacum
tgctcaccaacatacaggagggactgggtcagccctccatggagaggatggacgtgccatatgctcatctcttccaatctacggggaaggaaaggaaccaggagatgaagctggttacatcgttgggatgtcctcttgttatcctaaacctggctctatcaagatttcggaaggggaaactgtaactttaatatcaaattatagcagtgctcaaaggcatacaggagtgatggggctgttctatctcttagttactgaaccatcaccaacgcctaactctttcctgcattctacagatggaacaggtgagattgtaatattgcacaatgctgttggagtcttggcagtgtttggaattgca

SEQ ID NO: 757 - DNA, 419 bp, Nicotiana tabacum
atatgacaagatcacctcagtggccattccagctgctttggcagctactgctttgtttatgattgggagaggaatctacaatatgcctcatggcataggtaagaaggattaaatggtggtgtctgctcgaccatcgttcctatggcagctgaagtttgaagggggatattttagacctgtttgttcattttgtggacttacttattagtagctaatactggttagacgcagacaatagagcgtgccgatatatggcatttgccatcagtattcggcagctaaaacatttgctcatgtgtttgggtttatggatatttgtattagacggtgtcggtgtggaaatcaccatggcaactaatgcgtcttcctttatcgtattaactattaagtatgtcaaaataagaaatcccaagccataa

SEQ ID NO: 758 - DNA, 240 bp, Nicotiana tabacum
aatcttatgctgggcactatattcctgcttttgctgctagagtacacaagggaaacaaggctaaagaaggaatacatataaacttaaagggatttgccattgggaatgggcttacagatcccaaaatacaatacgctgcgtatactgactatgcattggacatgggattaatttcaaagtctgatcatgatcgtatcaacaaaatacttccagtttgtgaagttgcaataaacctttgtg

SEQ ID NO: 759 - DNA, 518 bp, Nicotiana tabacum
attttaggtgacattctttcctttttaatttgtcccaaaaaaaatgatggttgtatctacctctggtacagttgagtccatttaataaaggctctatatacctttgccagtaggtgcaggaacgctcacatatgtgtatatatgttgaatatatgagtatttactaagtggtgtatttgctagctttagatcttagattcgcctccgaagtctagccgataatggtgttttgtttgtttgtgtatgtaaagctcggtgttgaatacggagctgaatgagatggttgcagttaagaaaattgcgaatgcgtttgacaattacatggatgctaagaggactctccgtgagattaagcttcttcgccatttagaccatgaaaatgtaattggtttaagagacgtgattcctccacccttacgaagggagttttctgatgtttacattgctactgaactcatggacactgatcttcaccaaataattagatccaaccaaggtttatcagaggatcactgcca

SEQ ID NO: 760 - DNA, 397 bp, Nicotiana tabacum
tattatcgctgctgtttttgctgatcctctggtggacgctgttaataatttctccagtgccacgagcattccaactttcttcatctcattcattgcgctaccactggcaaccaactccagcgaggcagtgtcggctatcatctttgctagccggaaaaataagaaatccgcgtcattaacattttctgagttatatggagcagtgaccatgaacaatctcctttgtctgtcagtctttttggcaattgtttacatcagaggattgacatggaacttctcatctgaagtgctggttattctaatcgtttgcgttattatgggggtcttagggagtatccacaccacctttcccctctggacttgttcgatagcttttctgctttatccaatgtccctt

SEQ ID NO: 761 - DNA, 487 bp, Nicotiana tabacum
cacggcctcggcaacgacttcatattggttgacaatagagatacaacagaacctaaggtcagtcctgatcaagctgtgcaactatgtgacagaaacttcggaattggtgctgatggcgtgatatttgcaatgccgggtgtcaatggcactgattataccatgaggatcttcaattcagatggaagcgagccagagatgtgtggtaatggaattcgatgccttgccaaatttatagcggagcttgagaactcccgtggagagcgaagtttcaccatacatacaggggctggacttattgttcctgagattcaagaagatggaaaggttagggttgacatgggtgaacccattctgaaggcatcagatgtacccacgaaactaccccctaataaagatcaatctgttgataaagcaagactagatatagatggaagtgaatggaatgtgacctgtgtcagcatgggaaatcctcattgtgtcacttttg

SEQ ID NO: 762 - DNA, 298 bp, Nicotiana tabacum
cacaaggacttctcagtggatgaagatagccagtggatgctgcaaggatggaaaggacgtgtagtttacgctctctcttgttggaagcctgctcagcaatcgtaaaattatgtagtagtaacttattaggctatttctttgcttctcctatatatttcacctaaggttgagctattgtcaactttaggtcatggctgcttgattgaattttcttttttgtttgtagcagcattgtagaatctgtttatttggtttcaatgccactgaattattcagaagctctgccattatccataaa

SEQ ID NO: 763 - DNA, 200 bp, Nicotiana tabacum
ttcatttttcttgagccatgccggaatccaatttgaacggagcctattatggcccttccattccgccaccagcaaaatcctatcaccgccacggccgcggcagcagctgcaacccatgtagctgtctctttggctgcctctgcaattgttttttcaaaattatcttcacccttctgatcatcctcggagtcattgcatta

SEQ ID NO: 764 - DNA, 528 bp, Nicotiana tabacum
ctggtggtagtaacagtggggagggcataggaactcctcataatggagccttccaacataatcataaccaagcaagtgccacttttctgcctactgttgtttggttttattccttgagatctcactcttacgtgcatcaattgaagttcagatcagttgttcacttggtaaggtgcagctcccgagtgattgcaatcttacaagcagctcagatacactgttttgatgctgcaactctagagagggaatatactattgtcaccaatcctgttgtcacggggtttcctgctcctggaaccataggtgtgggacctctcgcagtaggtcccaggtggatagcctatagtggaagccagtttcagtctcgaattctggtcgagtcaatccacagcaccttactccttcggctagtttcccaagtccagctccaaatgggagccttgtcgctcattatgcaaaggaatcaagcaagcaacttgctgctggtattgtgactctaggggacattgggtacaagaagctgtcgag

SEQ ID NO: 765 - DNA, 348 bp, Nicotiana tabacum
ggctctttgcacttcaccaaatggtggtttgtttgctgctggttcagacagtgggatagtaaatatttataacagagaagaattttttgggggaaagagaaaaccaattaaggctattgagaatctcaccacgaaagtggattttatgaaatttaatcacgatgctcaaatattggccatcagttctagcatgaagaaaaatagctcaaagctaattcacattccatcatttacagttttttcgaactggccttctccaaatcgagccgtgcactatccacgctgtttcgattttagtcctcgcggaggattcatggctatgggaaatgctgaaggaaaagtgttact

SEQ ID NO: 766 - DNA, 334 bp, Nicotiana tabacum
gcctgcagccactgatagtgctggtggggaacgtggtttccactcctcacctgccgctgctgctgctgctgaatccattttggagcagaaggccttcttccgccctctagaggacttggacaaaccccagcacgcctaagtttcacattcccttaatagctccagtgcgtctatcctcactggcaaacttaagtctatatatagtgtgtagtggtggcttttaataagtttctgttttgcttgtgtttatgcgagtctgtattatatcaagtttaaagtgcagtatagactattagggtaaagctgcaccgcttttgaaggttccgttcatatg

SEQ ID NO: 767 - DNA, 271 bp, Nicotiana tabacum
  modified_base (114)..(114): a, c, g or t
gcataaaatgcagccctttaagcgatggactgatgatggaatgtgtttggcccttcttacccccgaacatgatcatttgataagcaggcagacagatgatgatgattacactcntcttgaaacgaactcgttccattttctcttttttgtttaattcaacttttactctcaattcagagcttattcatcttagtttacttagaatcttggacttggttaccacagacttagaaagtttccctccacagatactatgtctcatttggttgag

SEQ ID NO: 768 - DNA, 340 bp, Nicotiana tabacum
taacatttcttatcaacaggcaaacacacaaggcgttgtttggcaagtcagacttattcttcatttgcatgatgcaccctttatcatttgacattcaaaagcaagatttagaaattgaggcagcacaggtttgtcaagttcaatttaacaatattcaccagtgttattaaaagccatcacttcatcgcttcaagtgatgaaacgatgcaaggcaagaggttattgcttcatgggtgaaacgatgagtgcaaagtgaagcagtcggtactttgactctcaactttgaggagttggactaatatcgcatattgtatagtgaatactgcaattagtcattata

SEQ ID NO: 769 - DNA, 319 bp, Nicotiana tabacum
cacggaccttagggcttatacgccataatacgaattattcgaaacgagtcctgcaacgccaattgatcttgatcttctgttctgtacttccaaccactctccaaagcttctcatcagctgtatacggaaaatggccggcggaggagaccattctcatggcggagacttcagggctaaggtctggagtatgagtggtgggccctactgtaggcccaagcattggcagcgcaataccgctattgcccttgccggaatcgtactcatctgcattcctgtggctttgaaatccgccgagcttgagcaaaggccacatcttcca

SEQ ID NO: 770 - DNA, 200 bp, Nicotiana tabacum
aagtcatatgaatcaagattatggcttgacaacgtacgatccacgttatgctcatacaggctatgcggtagagtatgcacaccaaccacaatatacgccaccacctcctccaccaacgtatttaaacgcaccgcaaatgttcagtgatgaaaatcctaatggttgcaccatcatgtgaatgacacgaacttttaagtaaa

SEQ ID NO: 771 - DNA, 238 bp, Nicotiana tabacum
agactggttggagatgcctggttcattaatcctacttctagtggttgcacccaacctctttgctgacactttcagagacagttgggctggcactgcggtgtgtcttttgattggttgctatctgctccaagagcacatcagagcatctggtggattcagaaattccttcacacaaagcaatggtatatctaacacagttggtattgtccttctgttggtttatccaatctggtctctg

SEQ ID NO: 772 - DNA, 318 bp, Nicotiana tabacum
agaacagagtggtgtcggaataattctactctggtcccctgttttttgtttgcgaggaaattctcacgaggggctgcaatgcgcctcttgagtgaaggagtagtttctcagttcgatgcctcctccataatgaactcaactccgtgatttcatgagtctctttttaatagttttgaccttcacagtatacttcgatgaggggattagttgcccttgatagaattacaatctacgtgtgttacaacacctctagcttactgatataggaaatagacagacaggtggaagctgattgtagtatggttcatgtaagactta

SEQ ID NO: 773 - DNA, 507 bp, Nicotiana tabacum
tgccggtcttccctatacaacaatctctcttaattcagcgattgttgattcgaacagagctatggtaggaacaagcgcagtaattgaatcggtcagctccgctgtgatcggaaaaggggtggtagcggacagtcgacttgatctgacgactgtggcggagccggtgccgccagtggtgaaatcggacgatgtagatggcgcggttaatgacggtgaggagcagaagagggagattgtgttagggcggaacatacatacaacgtgcttagctgttacggaacctgatgctgatgatgaatctaccggtgataaggaagcctatatggctagtgttttggctcggtatcggaagactcttactgatcgaactaagtaccatttagggtatccatataatttggactttgattatggtgcactcacacagttgcagcatttttccatcaataacttgggggatccattcattgagagtaattatggtgtgcactcaaggcagtttgaagt

SEQ ID NO: 774 - DNA, 446 bp, Nicotiana tabacum
aaaatatggccaaaagccaattaaaggctctcctcatcctaggggatattacaaatgtagtagtgtaagaggatgtccagcacgtaaacatgtggagagagcactagatgatccaactatgtttattgttacatatgaaggagaacacaatcattcccattcaattacagaatcaccagctgctcatgtccttgaatcttcttaatctcaacggctcagatcttatttggatttgtgaagactaaatcagcaccgttgaaagcttaatgcaaaagatcaaatggtcaatgcctagaggaaaatgaaaaggaagaggcaacatttgtttatttttgtttctctatgtaattgtcgttgaaaacttttgattttgcgtggaaaatgaaaagaagagatagagagcaaattgtggatttggtgggaattgaatcaatgcaacatagtgg

SEQ ID NO: 775 - DNA, 289 bp, Nicotiana tabacum
tgccacaatataaagatttgcccccggaagaggttgaggagtttcacagacgggacgggtttgaggttggagatgctgacaagatatttgaaagtacatcgaaggatcagttaacccgtcgtgctgcatgaggaagagtgctaaattagttgaatattttgactgtatgagctaatttttggcatgttcagctggaagattaatccaaagttaactgttggaggatgatattgtagctctgaagtgtataatctgatcttctgtagctatttaaaagaataaaattact

SEQ ID NO: 776 - DNA, 250 bp, Nicotiana tabacum
agaggcgaaattatcaagcgagcgtcaacgaacgccggagaaaatgccgtctgaaaaagagattgaagagttttttgcagctcgccagaaagctatacttaaacgatttagaaaaaagtacaacttcgactttgagaaagaggagccattggaaggtcgctacgaatgggtccgaataggaagttgaagattgaattcgcaagactgaccacaacagtatcaattgctgctgcttcatttatttttgctg

SEQ ID NO: 777 - DNA, 345 bp, Nicotiana tabacum
ttcatgaatctgttaataattccttaagactctctgtttctgatcttcctatgctttcttgccagtatattcaaaagggtgttttgttaacccaacccccaactgaattaacttccactcatcttatttcccatctcaaaatttccctttctaaaactctctcccatttccctcccttagctggccgtctgatcactaattccgatggccacgtgtatatcctctgtaacgacgctggcgtcgactttgtacacgcgaaagcaccccatcttacaattgccactctaattccaccaaattactccgatttgccactttacttcagaaaattcttccaattcgata

SEQ ID NO: 778 - DNA, 431 bp, Nicotiana tabacum
gcttattaggatgataaagtcgctttgccccaagatagtcactttggtggagcaagaatcaaatacaaacacggccccatttttccctaggtttttagaagctctggactactaccatgcaatgttcgagtcaatagacgtgaccctagcgagggacaggaaggagcggatcaatgtggagcagcattgtttggctagggatatagtgaatgtcatagcatgcgagggcaaggaaagggtggaacgtcacgagctactggggaagtggaaatccaggttcatgatggcaggttttcggcaatatcctctgagctcttatgtgaattcagtgataaaggacctcgtgaggcgttactcggagcattatacactagtggagaaagatggggctatgctgttgggatggaaggagaggaacctaatctctgcat

SEQ ID NO: 779 - DNA, 261 bp, Nicotiana tabacum
catggccagccaatctagcaagcctcaatctatttatgacttcactgtcaaggatgctaagggaaaggtccttatcattgtcaatgttgcatcacagtgtggcctgactaattcaaactacactgacatgaccgagatatacaagaagtacaaggatcaaggtctggagattcttgcattcccttgcaaccagttcggtggacaggagcctggaagcattgaagagatccagaacatggtttgcactcgcttcaaggccga

SEQ ID NO: 780 - DNA, 608 bp, Nicotiana tabacum
accatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctct

SEQ ID NO: 781 - DNA, 314 bp, Nicotiana tabacum
agcagaaagaccgtaaagcagcagatatggagccaaacaaagtatcaacatggagcaaaatagtaggggtgttacacactttcttggaagagctaactgcacctccaacacttggagctattgtaggattcctgtttgggtctgtaacatggctgaaaaatctggtgattggtgacgctgctccacttagagttattcaagattctgtcaaattacttggggatggaaccattccatgcatcacccttatacttggaggcaacctaacccaaggattgagaaaggcacaagtaaaaccattgatcataatagca

SEQ ID NO: 782 - DNA, 440 bp, Nicotiana tabacum
atgttcaaatctgaggtgtggcatctgtgtcgttttgaatctgtttgttagagtttctgtccccgccacggataggctgttggttgtaatattatcgtcaatccttttgccttttcttgtggatgggctcttatagcagtaatttcttttgctagtgtctactagtagtagttgctcttattctatcaaaataattctgtgattgaatctagttttcaacttgcacatgttagtttcttcctttgacattgtgattgagtctggtgtccaacttgcacatattagtaatcgttgttgtagtcttattatatgtctctgacactgattaaatatcttgtagtctggttgctgcaagccctcaaacgactgcaactccgagtacgtgagcccaacaaactggactaggacaccaagctcatcccttaataatcctgactgta

SEQ ID NO: 783 - DNA, 338 bp, Nicotiana tabacum
agcagtgttaagagggaaggttgaagaattagcaaaagcagagcaaagcgaggtgaatcaaagggggagtttgatagaagctgttcaccaactcgaagaaaagatagctacactgcagaaactgacagcagataaggatgaaaagatagcagagtatgaaaagaagatgaatgacaaagataagggaatcttagacttgagtgagggaaaaagggaagcgatacgacagttgtgtatatggattgattaccaccagagtcgatatgatggtcttatagagatgatctcaaagactaggggaagaaggcaagtaactgcttgaaattccttcgcaaatg

SEQ ID NO: 784 - DNA, 234 bp, Nicotiana tabacum
  modified_base (17)..(17): a, c, g or t
  modified_base (84)..(84): a, c, g or t
tacttagggttggtgtnacttgaaactattgcaaagaattgcgagaaggcattctcagagattgcagctgagagggttctggangagatggtgaagctaattgatgaccctcaaactgttgttaacaatcggaacaaggccctggtgttaattgaagcttggggagaatcatcgagtgagcttcgctatttacctgtgtatgaagagacttacaagagtttgagatccagaggg

SEQ ID NO: 785 - DNA, 365 bp, Nicotiana tabacum
agaaacaatttctcttgcacaagtagctgtcatgggagtagcttatcaagttaaccaattctggttccctctcattatcctcctcctctccattaccatttcttctatttctggagctgaaccaaattgtgtgtacacagcttacattcggactgggccattcatggaggatgcaactgactcaaaaataagcttgactctctacgatgcgagtggctatggaattagaatcaagaacctagtggcttggggtgggcttatgggctcagggtataactactttgaaactgaccactcagatatgttcagtggccatggaccatgtttgactgggccgatctgcaaaatggtcttgacttctgatg

SEQ ID NO: 786 - DNA, 351 bp, Nicotiana tabacum
  modified_base (250)..(250): a, c, g or t
tacatttgatatggccaatggacttgctcctaacgaggcagctcgtaaaaagaagccctcaattaaaccccataaacaacacaagaaatcacaaagaaagaaagaccggtcgtggagggtccagaatggtgatgctgatgggatgccagtagtaagagtcttccagaaaccagctaacactggacctgtgagcatccgataggtgtcgatggaagttgatatctttgctcagcggcgaactgctcaaganggaaaaaaaaaaggcaaaacatgttatttctgatagttggctctttggctcctgcctctgttgccatgtgaactgccgtttcttaccctacattattgcaa

SEQ ID NO: 787 - DNA, 264 bp, Nicotiana tabacum
aattcgtcatggtagaggcagttgaagaagaggagctcttgataatgatgaaaaattgttcttcgtcgatggaaggcagcttgggccaatctgtcaagtgaaatttgttcccaaaatatcgtcgtaaatttacaagagctttgtaagcttaattctttaccagtttgagaatggatttatgtttcctcatcaaccacttttcgtggctgtccgttgatcctttgatctagcttctgaacttaccactaccattttccaacagag

SEQ ID NO: 788 - DNA, 407 bp, Nicotiana tabacum
agaggcgtaagacggagaccatggggaaaatacgctgctgaaattcgtgattcggctaaacatggtgctagagtatggctaggcacttttgaaacagccgaagaagctgccatagcttatgatagagcagcctttagaatgcgtggtgctaaggcactcctcaattttccgtctgaagttgtcacagcctctgcttcagtagatagattactactacgtcccccaagtttgagctcagatagttacactaattccaacaattcaaattctagttcaaatgaagtttcaagtgggttgattaatacatttgaatcaagaatttcaacggaattttctcaagatactaagacagagtatatggagaattccttggcactttgaaccaattgcacggtcgatgttaagtt

SEQ ID NO: 789 - DNA, 363 bp, Nicotiana tabacum
taccctttgatggattgggtttagtgccttatacacagcagcatctgacttggactcaacatgctttcaatgagaagattggagaggttcagagggtcgcgaaggagtcgtttgtgaggttgaaaaggcgatggtcttgcttgcagaagagaacagaggtgaaacttcaagatttgccagtcgtgctaggggcgtgctgtgtgttgtataatatatgcgagatgaagaatgaggagatggatccagagctcaatttcgagctcattgatgatgagatggttcctgagattcaattgagatcgactgatgctaggcttgcaagggatgcaattgctcataatcttttgcaccataaccatgctg

SEQ ID NO: 790 - DNA, 493 bp, Nicotiana tabacum
tgcaagcatacttacaattaccaatcatcaaaacatttggagaaataagaaaatgtccttaccggagcttgagctccctggcttccgttttcatcccactgctgaagaactcatcaacttctacctcaaaagcattatcaaaggcaacaaacttgactccaatgtcattgcctttgtcaacatatatctccatgatccttgggagttacctggattggcaagaataggggaaagagagtggtatttttttgtaccaataaacagagaacatggtcctaaagggaagcctaacagaacaacaagaaatggtctctggaaggcaactggttctgattgccaaattcgttcaacattagacccgaggaaggttattgggctcaagaagactttggttttctatggtggaagggcacctaaagggtgcagaactgattgggtcatgaacgagtacagacttcctgatggccaccccttacctaaggatcatgacata

SEQ ID NO: 791 - DNA, 381 bp, Nicotiana tabacum
aacctgggtacggatatccaccggtgcaacaacctaagaaaaagaacaagtttggaatgggaggtggattaggcttgggattgggtgctggattgcttggtggtttgttggtgggagatatggtttcggatgttggagagatggctgcttatgatgatggctacggagatgccatgggagatatgggtggctttgatttttagattagttttggtgctttgtaattttgtttattttgttctttggagatataataagctgcagtactgagcaggctctgctcgacgagttaaaggctttggaagagcatctcaaggctcacggaccatatgtcaatggggcgaatatttgttcagtcgatttgagtttggctccgaaact

SEQ ID NO: 792 - DNA, 298 bp, Nicotiana tabacum
atatgaagagatgattgagaattaccacccgggtcttggtgatcataggtggccacttgttactcactttgtgggttgcaagccttgtgcaaagtttggagcttattcagtagagaggtgtttgaagcaaatggatcgtgcattcaactttggcgacaaccagatccttcagatgtatggattcactcataaatcacttggtagtaggagagtgaagagaacacggaacgaaacaagcaatccgcttgaagtgaatgatgagcttgggttacttcacccaccatttaaagctgtcaag

SEQ ID NO: 793 - DNA, 259 bp, Nicotiana tabacum
tacttactccttttaccataggaagcattatgtgcagagaaacattgaacaaggaatctgttattgaggagattgttaatgaagctcaagattccatacttcctggcacgagtgaagctgcatttcttgaaagagtctccaaacttatcgatatcaggcttgagaagatagagaattaactcttctctagaattgtaagtatgtatttgttgtatatatacagtgaccagtccataatatgtagatggaactgaaggca

SEQ ID NO: 794 - DNA, 371 bp, Nicotiana tabacum
aataaacctagttatcagctttctgctattcaacttgccaaccaactggttgaaaggaacatcgacttggtttatggaggtggaagtgttggcttaatgggtctagtctctcaagcagtttttaatggtggccgccacgtgttaggggtaattcctaaaactcttatgccaagagagattacaggagagagtgttggagaagtgagggcagtctcagggatgcaccaaagaaaggcagaaatggcaaggcaagctgatgcatttatagccttaccaggtggctatgggacattagaggaactcttagaagtcatcgcttgggctcaattaggcattcatgataaaccagcaggtttacttaatgtagatgg

SEQ ID NO: 795 - DNA, 266 bp, Nicotiana tabacum
ttgattctgatagcagtgattccgaggttggtcctaaagagcaatctcttgcgggtagaagtcaattgggtagtggattctctcgtaggactaaagcctcttcctccagcttagatacaaacttttcctctaagtttaaaatgagctatgagccagctgttaattccgactcgggtttagacagaaaacccagcaggaactcattcagtgctaaagtacaggaaccccagaaacctgtcatgagttcttatgttgctgatacacaa

SEQ ID NO: 796 - DNA, 272 bp, Nicotiana tabacum
cagagaacctcaagaagctgctccatcgtttccaagaaactgatgaagatgtacacagctctgaggtggacagttctgcatctacaaaatttgatccaaatgattaccaagtgaactcacaagtcactgacacgaccagtcttagcagtgtgcaggcctcagaatatgaggatgctgaatcagcgtacaatcaacatccaacttctggatttcactcatttcttgatgctcagccaagtatgacgcagaaagctggagagggccttgctgta

SEQ ID NO: 797 - DNA, 382 bp, Nicotiana tabacum
gtgaagaaagcaaataagaaaagatgagtagaatagtagagtatggttggcaaaacacgtcgtcgaatgagtatcttgatcatattaaacgaatggagagatcgccaaccatgcaccctgatcttcctctctacccaaatgtccactccctcttcaaaaatggatcagggagcaacggacaagaaaagaaatgcactctaccgcagtcccagaagaaggttcatttcgcggaagcagctgaacttaccaagaacgaaaagattgaaacgaagaatattgacatggaggctgatggatatataaagcagaagcacatgaactttgagctccacaaatggagaaccttcaaagcttgttaaagagtttccaacttgcttataac

SEQ ID NO: 798 - DNA, 422 bp, Nicotiana tabacum
tcaagaaccagcgtcaggcacgtttctcgatcgcgcggtccgatgtggttcagctcttaaaccttggacaccatgaaagagctcttctgagggttgagcaagtgatcaaggaacagaacatgttggatgtgtttgtcatggtagaaggctattgtcttctgttagtagaaaggatcaaccttctggaacatgaaaaagtttgtcctgaggaattgaaggatggcaatatcgagcttgatttatgcagcttcaaggtgtggcgatgttcccagaacttcaagatgcttcgtgttatcttcacgtcaaggtttgggaaagaattcacagctcgtgctgttgaattaagaaacaattgtggagtaaatcctaagatgattcaaaagctgtcaacgaggatgcctagcttagaacatagaaccaaa

SEQ ID NO: 799 - DNA, 298 bp, Nicotiana tabacum
ctagctgatggagttggtgaggccgctcagatttattgtgaattagtccgtcttggagcgggtatgaagttcattgatattggaggtgggcttggaattgattatgatggtactaaatcatgcgattctgatgtctctgttggctatggcactcaagaatatgcctccgcagttgttcaggcggttcaatatgtatgcgaccgtaagggtgtgaaacacccagtgatctgcagcgaaagtggcagggcaattgtttctcatcactcaattctgattttcgaagccgtgtctgcttcta

SEQ ID NO: 800 - DNA, 288 bp, Nicotiana tabacum
gggtgaagaatagatcaaaagcttggtgggatcaatgtaacagtgctgatttccccgatgaggagtttaaaaaggcgtttcgaatggggaaagatacatttgagatgatatgtaatgagttgagctctgtggtggcgaaagagaacactatgttaagagatgctgtgcccgtgaagcagcgtgtcgcggtttgtatatggagattggccactggggagccacttaggttggtttcgaagaggtttggattgggtatttcaacttgccataagctcgtgttagaggttt

SEQ ID NO: 801 - DNA, 244 bp, Nicotiana tabacum
tccttgcatatttggtgttttgacatgtgataccttggagcaggctttcaatcgtgtcggtgggaaggctgggaataaaggtgccgaaacagcgttgacagctattgagatggcgtctttgtttgaacaccacctaaaggcttaagaggtggaggcggcccttcttacgagctcactgtttaccgcaagaatgttgttgtgattcttacctttaaaaagaaacttgttcccgtcaccatctgaa

SEQ ID NO: 802 - DNA, 296 bp, Nicotiana tabacum
aaagcagcgcagccagagttttattgaccgtagtggaattggccatcgttctggccccaatggcgttgctaattcaccacctttgatgtcatctaatatgtcggattggggctccccgactgggaaattggagtggggctttaatagcgaggacacgaacaagctcaagagatctcaatcttttggttttcgcggtggaaatgctgctccaacaagatcaccaatcgcaccatctcaagtcaatgagccagatgtctcgtgggttcattccttggtgaaagatgtgtcctccacgg

SEQ ID NO: 803 - DNA, 451 bp, Nicotiana tabacum
gtcatataaactcgttatcattttcaccgctctccttgtggttattgctgcttgctccacgaaaattcatgtgatggccctaagagatctacctaaagatgtattaccaattgcagcgaaactatttcaagaacaatatgatgcaacttgtgggaaaccttgtaatactagggacgattgctctaaaggttggctctgtagtgaatgttataattttagaaagacttgtgggccacttattggtgatgttattatgggcatgtgatttcagtattacttctccttccgaccttcctgagcaccggacaagtggcagactttatacatcgtgttacctcgtattaacagagtaacatagtcctgtatttttaataaataaatagccgctctaccaatccggttgagttgttgttgtgttgttttagtgtctcttttgtctttgaaattgtct

SEQ ID NO: 804 - DNA, 274 bp, Nicotiana tabacum
ttacgttaagtatggctgaccaccctaatcttgtcaaattaattggttattgtgtcgagggagatcacagggtgctggtctatgagtatatggctcttggttcactagaagaccatttacatgacccttggccagataaaaaacggcttgattggaacacgagaatgaagatagctgcaggtgctgcaaggggcctggaatatttgcatgacaagatgaaaccgcctgttatttatcgtgacttgaaggggtcgaatattctgcttggggaggg

SEQ ID NO: 805 - DNA, 329 bp, Nicotiana tabacum
gttatagtggcgctcgatatgttttcacgtatattgcttatgtggttcgtcacaaacaagtattcgctgtcaaagtattttaggagagttctgtttgaggtaggttgagaccagatcaatcgggatgaagaggcaactagtcaccaactattgacaaggaaaaaaacgtaattacatccagtattacaccaacctagtcctaatgtgacatgttctcacatgtacatttacaaatatataccccaatttttatttaaccattataaattactagtacatagtttttgtgtaagtatcgggtgcttatgttttttgcctaatgtcgctag

SEQ ID NO: 806 - DNA, 269 bp, Nicotiana tabacum
gctcatttaaattttccacatagaatcggtttaaatgaaccggaaccggttcgagttacggcgaaaagacgagcatcgcctgaaccggctagttcgtcggaaaatagttcacctaaacggagaagaaaggctgttgcaactgagaaatctgaagcagtagaagtggagagtaaatcaaatgttttgcaaactggatgtcaagttgaactattgacacgtcgacatcaattattagtcagttaagtatgaacttaggatattcaattgtg

SEQ ID NO: 807 - DNA, 526 bp, Nicotiana tabacum
ctcaagcaatttccatgtcttacgacagaaaatccttcgagtgtgaagcatcatcgcatgtgaagctgcaaaaggaagaagagattgacatggaaatcaattcaggcaaaaatggagctatagcacaatgatttctttcggaattgttcaataggagatacagactcaaatcagcatatgcagtggaatggcgattctgttaaacatgtcttcttgtaaataactacctggtaatcgttagcggggtcgagcggccgcccgggcaggtagcaaaactatgtatagttattcttcctctcctaatggcatgtcttgtcggcgtttcacgtgtggatgactactggcatcattggcaagacgtgtttactggaggattgataggccttgtcgttgcaacactctgttacctgcagttcttcccagctccataccatacagaaggatggggaccatatgcatatttccgagcagtggaggagttccgcagtagcacgcaacatgtccaccctactaacggaggattaga

SEQ ID NO: 808 - DNA, 306 bp, Nicotiana tabacum
ttatggccgtggttgacacattatcaactcattcacccgacgaagaatacataggagatagacagcaaccgtctacctggaccggggatgcagagattgttgaagcgttctatgatttctcgtccgaaataaggagaatagagaaggagatagatgataggaatgctgatacgagattaagaaacaggtgtggtgctggtgtgctaccatatgaactattggcgccaagttctgaccctggagtaacatgtagaggtgttccaaatagtgtatcaatatgagcatgtatgtatagttatgatgcaa

SEQ ID NO: 809 - DNA, 360 bp, Nicotiana tabacum
tagttatcgccaaaaccttgttacctcagtgagtcacactctgtaaaattgatagtgattaggatgaaggctgtagtgataacaagtccaggtgggccagaggtgttgcagatacaacaagtggaagacccacaaatcaaagaagatgaagtgttgatcaaaatagcagctactgcccttaatagagctgacacccttcagcgccaaggtaaatacccaccccctaaaggtgacagtgaataccctggtcttgaatgttctggcactgttgaagccgtcggcaaggatgttactcgctggaaaattggtgacctggtatgtgctctcattggtggtggaggttacgcggagaaagtagct

SEQ ID NO: 810 - DNA, 277 bp, Nicotiana tabacum
cgtctgtgtcatcaccagcaaatcacaagtccttttatgtgtcatcatctttattatctccttcaccaaaatcacctctatcgccgttgacttacaacagaaatctcagagaagaggaggagaaggaggaggcggtgtgttccacgtcatcatcgtcgacgattttgaagaggaaaagaccggcgaggatcacgattccgattggctcgttgagtttagaacacgcgccgagggaagagagtggtcaaatggatgaagtggaagttgaagaagaagg

SEQ ID NO: 811 - DNA, 336 bp, Nicotiana tabacum
cttcgtcaatggagaattcggggactttggttatgttgctcctgagtacgctcgcactcttatggctacaccaaaaggtgatgtgtacagtttcagtgttgtacttcttgagttagtaactggtgagagaccgacctctgtcaccaaagctcccgagacctttaagggaaatctcgtggaatggatttcaaatctctctggtgaatctaagcttcaagatgcgattgaccattcgttgtctggtaaaggttatgacactgagattttccaggtccttaaagttgcttgtcggtgtgtgttgtctgctcctaaggagaggccgacaatgtttgaagt

SEQ ID NO: 812 - DNA, 295 bp, Nicotiana tabacum
attatatgatgatcatttttaaaataaaaaagcgccatcaatagaatcactgcatgaagaaaccaacaagggagaaaagcagagaggttccgatcaaagcaccagaaatcggcaaagaaaaaccagctccggcgtcgggcgatggcgccggtggcattccaacttcctgtgccgaagctgcaatggcagcgaccatgacaacgagcacgaatgccttgacaatgttaacttgcgccatttctataaaattgaagaaagaataaatactcaaattggtttcaggagctgatattga

SEQ ID NO: 813 - DNA, 364 bp, Nicotiana tabacum
cttattaggaccaggaggcaacaaacaatcaagaggtgtaaaagtcatattcccaagtggtgaaatcagacatttttatcaaccaataaaagcagcagaggtaatgctagagacacctaatttctttcttgtaaacacaaggtcacttaaaattggaaggagattttctgctctgaatgctgatgaagatcttgatatgggcaatgtctatgctatgtttcctatgaaaagagtaaattcatttgtctcagcagctgatatgggagctttgctacttactgctaactctgtgtccaaaagggtgtcaattggaagtttcagaatcttgcctgaatcatgtgtagagtattctgctttggaaata

SEQ ID NO: 814 - DNA, 314 bp, Nicotiana tabacum
aggaaaaaagttgaggagggaaagaggagggaggcctctttagaaaatgatttggcaaatatgtgggtgcttgttgcccagctaaagaaagaaaatactgctaggcgagactcaaagctggcaggtgactggcagaatgatggagaaaacaattcgattaatccagaaattaatgatggtgaccacaaggaccccatcccggatgttagccaagacggggatcatacaaatacagctgctgaggttacgaaggaagaacctcttgttgtccgcttgaaggctcgaatgcaagaaatgaaggagaaggaacacag

SEQ ID NO: 815 - DNA, 419 bp, Nicotiana tabacum
gcaaccaagcaaacaacatgttcctttttcctggaataggacttggtactctcctgtcgggatctagaattgtttcagatggcatgttgcaggctgcagctgagtgcttggctgcatatatgacagaggaggacgtcctcaagggggttatatacccttcgatatccaggatacgtgatataacaaaggaggtagctgcagctgtggtaaaggaagctatagaagaggatctagcagaaggatactgtgaaatggacagtcgagagttacggaaacttggtgaggtatttttactttatgaaccagttatctttggagatatataggagcttcccgaaccgtgtgttgcacctgggactgttttgactatgtataattaccccagtatgaatgaactaaccaataatatatagtatgaa

SEQ ID NO: 816 - DNA, 749 bp, Nicotiana tabacum
cccctcccgacagtgccggggtatgatgttgctggtgtggtagtgaaagttggtagtgaagtaaaggggctaaaagaaggggatgaagtttacggagatatacatgaaaaagcattagatggaccaaagcaatttggatctttagctgagtacactgctgtagaagagaaactagttgctttgaaacccaagaatctgagttttgcagaggctgctagtcttcctctagcaattgaaactgcttatgaaggtcttgagaaagctggattctctgctggcaaatccatacttgttttgggaggtgctggtggtgttggatcccttgtaattcaggttgcaaaacatgtatttggagcttcaaaagtagcagctacatccagcacagggaagttggaactcttgaaaagcttaggagttgatttagctattgattacaccaaggagaattttgaacatcttcctgagaagtttgatgtcgtttatgatacagttggtcagggcgaaaaggcggtgaaggcagtgaaagaaggtggaagtgtggtagtgctaacaggggcagtaacagcaccaggttttagatttgtagtgacatcaaatggagagatgttgaagaaactgaacccatacttagaaaatgggaaggtgaaaccagttattgattcaaaaggaccattcccatttgataaggttgtggaagctttctcttatcttgaaactggcagagctacagggaaagtcgtcatgtaccc

SEQ ID NO: 817 - DNA, 184 bp, Nicotiana tabacum
cggggataggctttgcgactttagtgacacatctgacttttggtcgcttgcttcaaggttttgattttagtaagccatcaaacacgccaattgacatgacagaaggcgtaggcgttactttgcctaaggttaatcaagttgaagttctaattacccctcgtttaccttctaagctttatttata

SEQ ID NO: 818 - DNA, 262 bp, Nicotiana tabacum
cggcgatgtctagctctttagttgttgggctcgtcggagagtggcggattcacggcggcactatcgtcggaggcttttcccggctacgactacgccggaggaggaggaactgtggggacggaggaagttagtccaccgccttatccattttctttattaggcggtggcttttagtttgtgagaccttcgttttgtaattatgtttattcatgcaatatgttactaaatgcatctgaaaagtgagacctcctagttaacctta

SEQ ID NO: 819 - DNA, 525 bp, Nicotiana tabacum
cggggaaaatattgcacacataagaagggaacatctggggataaatttgagttcaaggcccctcggagtgggatgtacaagttctgttttaagaatccttattcaacaccagaaactgtctctttctacatacatattggacacatccccaatgagcatgaccttgctaaagatgaacatttggaccccattaatgtcaaaattgctgaactaagagaggcattggagtcagttacttcagagcagaagtacctaagagcacgtgatgctcgtcatcgtcatactaatgagagcacaaggaagcgtgttatattttacacaattggagaatatctgctgcttatattggctagtgggcttcaggttgtgtatatccgacaactgtttagcaagtcagttcgctataaccgggtttgacaaatttaggttgtagcatagtgttttttcacctctgttctacaggaacttgagttgttttggtcagtgagggaagggcatccctctgtagcatcttttcttaagtta

SEQ ID NO: 820 - DNA, 577 bp, Nicotiana tabacum
cggcacaggattatgaaattcttgagagagcaagctgcattatcagcaactgaaataacagtggattcggtaaaggaatttgcggctgagtctgaaggtgacagtggattggaagaattagcagattattctaaggaaaccaaacattcgtgggagaaaatcctcaagaatgttatggagacatcatctgcaagtatgagtactgaagatattttccaactccgtagtactagtattcagattcccaaggtaaatgggaaacataacaaatgcatgcagcatatgagtttgaaggccacaggggagacattgtcacaaggaaatggtgttggcaaaatgatacttgctaacataccaaggtacagggaagttctgccaggattggacggctggctggctagcaaagttgcaacttggcataacctggaagggcactctgtccagtggctttgtgttgtcagcatggatcgaaaaggcatgatggcgaatgttacttcagcattggcagcccgtaggcctcagcatatgttcttgttcggttgagacgggatagagggaagggaatggctgtcgagct

SEQ ID NO: 821 - DNA, 563 bp, Nicotiana tabacum
cggctaaaactcaataatattttttggctcttataaaaaggagtatgtaatttcaccccttttaagatggaatagtagaaaagaatactatatactttaacccccaaaagtaatattgtaatagttccaactatttcgaagcgggagtaaagggcctctttgtcgtcctgcttgccactcgaagggctacttaataattaacgcctgacatattaggagttactattactgttttgtaacattagtgcatctactttattttactacatatgttgttattttatttccaccatttaaggcgtttgttattttattttttttgctttctggtctgttaactaggcctttgtaacttgtttgtgtatataatcagctaatcattatttaataaaattatttttttttgtttcatcttgctcattcattatatggtatcagagtggtctccttgactctcatgagttttttttttcgatcctctaactaccaccacaagctcacacttaaaatggcccctaatgtaacaaatgttgactctactagcaacaactctaatggtattg

SEQ ID NO: 822 - DNA, 562 bp, Nicotiana tabacum
acgaacagtccaccttttgggaagcctcgagtacttacattgaagcaggatttacattactggccaacatgggagctgaggtttgatccaggaactgctatgtggcgacgcaaaacaatcaaagctttgactctggtgttttgtgaacttacttggctgattaggttttcctgtggggagtgcaaaattggggaacgtgtagaaagttcaccggctgcgttggtagttactctaacttattggagttgaaagtcgccatacatcaatatatgcaaaatcatataaagcaggtatctggctttatatactatttgttgtaaatgaccatttatcagatgaaattaataagtggtagaattttagacaagttataagtgctagcgctatacatgtctttgtgaatcagagtatgtaaaccatgaactaggaggggactttttgccaccagattcttggttatacccctttttgccctctaggctaaatccattttttttccttttgaaatcattgtgtcaatttagctgacagtgttagatcccatttatgccattgctataat

SEQ ID NO: 823 - DNA, 444 bp, Nicotiana tabacum
tattaattcattaaacagtgtatcccaagttaacacttaacaaccccagctaaaactatgaacagatgagattttccggttttacccctcgcctaactacaaaggtaaaattacaagaaagggcctagtaatctagtacaatactactgcattacattcctgattcaagggtaggaaagccagaaaaagagttaaatccaaacacacccgaactaccgtcaacaatcaccgcagacggcgaatgtgcggcggagagagtccccgccggtggttgagccataaacgatgaagtggggtccagtaaaaaagctgatgtatcaagagtaggcaagcagctaacttgctgaacccggtcaaccggtcgtctcggcttcggcttcaaaatagaagcaaccgtcacgtgtccgtttccttccattctcactccggtcacctgctgtccat

SEQ ID NO: 824 - DNA, 446 bp, Nicotiana tabacum
gggcggcgggggtgtccggggcgtaagtcccgactgccgaggtgtaagtctcacggaactaagccccacacataagtcccggggcgttttacgagtgctccgctccagggcgagccccgggcgagtcccaattctgccttttaaaacagagctaattactatagtacaaagtaattttattctgtgcagtggagcatgaagtactcgaaagagaaagaggaagactacgagcattatatcagcaacagcaactgccacagtcacagcagcaacagcaatcatcttccagccatcggcgcagcactagtagggatcttgatcaacaatttgcaaacatctctttgaaacataaagacgtttcaggccaacttcacatgtgactctgactgtagctaggacgtaaatcacatcttcctgactctccctcagctgatttttcctggaat

SEQ ID NO: 825 - DNA, 238 bp, Nicotiana tabacum
aatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagcccggaagcataaagtgtaaagcctggggtgcctaatgagtgactaactcacattaattgcgg

SEQ ID NO: 826 - DNA, 382 bp, Nicotiana tabacum
ccggggtggacgtcgtgaaggaggcggcggatacggaggtggaggatatggaggtggaagacgcgagggcggcggtggtggttacggcggcggcggttatggtggtggccgtgaccgtggatatggcggtggtgaccgtggatacggtggtgatggcggatcacgctactcaaggggtggtggtgactctgatggaaactggaggaattagataattgagaagatgtggattttagttattttgatcgcattttaagttgggtatatcttaatgttaagtgtgactgtcttttttgaccgttattggctcgttactttactgtgtttttctgtttacagagttcttatggaatgaattaaatgaagtctacaaattaaatct

SEQ ID NO: 827 - DNA, 279 bp, Nicotiana tabacum
cggggtgctggtggtggctatggagctcagccgatgcagtaccaaaatccgcagatgcagggcggtgcaagaccacagggtggtgcaccttacccaggctatggaggtcactaggaaagcttaagattccttgataaaatgcatcaaacttttagttttggactggtgattcttctgaagttccgggcactctccaaatgaagtcttttactatgacaaaagttaccttttgcttaaagaccatgatcttcaatgtgtattttctttttattcaagtaa

SEQ ID NO: 828 - DNA, 277 bp, Nicotiana tabacum
ggggtgctggtggtggctatggagctcagccgatgcagtaccaaaatccgcagatgcagggcggtgcaagaccacagggtggtgcaccttacccaggctatggaggtcactaggaaagcttaagattccttgataaaatgcatcaaacttttagttttggactggtgattcttctgaagttccgggcactctccaaatgaagtcttttactatgacaaaagttaccttttgcttaaagaccatgatcttcaatgtgtattttctttttattcaagta

SEQ ID NO: 829 - DNA, 243 bp, Nicotiana tabacum
agagcccaacaaggcaaagagctgcaacaagtcccaaagctgtaactccagtacaatccaagaaaagccatatatcagcaagagaggtgtcctttccagtcaaatggagtttatagacaatgccatactggaagacaaaaaaatctgagactcaatattgtttctagtatccgtcctctcaaagtctggatatgaatctgttcttcatcccaccaggactcccagctgtcgtctccccggaca

SEQ ID NO: 830 - DNA, 266 bp, Nicotiana tabacum
  modified_base (191)..(191): a, c, g or t
cggggtgatgaattcaagggttacgtattcaagattatgggaggatgtgacaaacagggtttcccaatgaagcagggagttttaactccaggccgtgttcgccttttgctgtaccgcggtactccttgtttccgggggtatggtaggagaaatggtgagcgcagaaggaagtctgttcgtggatgcattgntagccctgatctttctgttctgaatctggttatcgtgaaaaagggtgagaatgatcttcctggactgacagacac

SEQ ID NO: 831 - DNA, 514 bp, Nicotiana tabacum
tgtcgaaaaccacaatttaagaaatttgcacgaattcgaacttacacagtgaaataaaccgagaaatctaatcttattccaattctaacttgcactggtagttttaaaaacgaccaattacagtaaagacccgacacagtaagcccgaaacccgacccacaataagctcaaaaaggaaaaaactggaaaaaaaaacgaaaaacggcagatcagtacgctgcgatcacatagttaactagtttagatcatcattaacattaattaatacgattaataatctaagagagttgaccacagtcagcaatcacaacgggcttcgagcacctgccggagctagatccaacggcctccactttcttaatcacatccattccttcaataacttgaccaaacaccacgtgttttccgtcgagccactcggttttggccgtacaaatgaaaaactgcgatccgttagttccagggccagcattagccatggagagaattccaggtccagtatgctttttaacga

SEQ ID NO: 832 - DNA, 299 bp, Nicotiana tabacum
acctatattccctagccaatttttattagttctattgttaaaggttaactaggaggtctcacttttcagatacatttagtaacatattgcatgaataaaaataattacaaaatataggtcacacaggctaaaaaccacctcctaataaagaaaatggataaggtggtggactaacttcctccgccgccacacttcctcctcctccgccgccgtagtcatagccggaaaaagcctcggacgacggtcccgtcgtgaatccgccactctccgacgagcccgacgacaaagaactagacata

SEQ ID NO: 833 - DNA, 298 bp, Nicotiana tabacum
cctatattccctagccaatttttattagttctattgttaaaggttaactaggaggtctcacttttcagatacatttagtaacatattgcatgaataaaaataattacaaaatataggtcacacaggctaaaaaccacctcctaataaagaaaatggataaggtggtggactaacttcctccgccgccacacttcctcctcctccgccgccgtagtcatagccggaaaaagcctcggacgacggtcccgtcgtgaatccgccactctccgacgagcccgacgacaaagaactagacata

SEQ ID NO: 834 - DNA, 517 bp, Nicotiana tabacum
cagaataacatgagaaatctataattttgaggaaggtttgcttgaactccgaccagcaatgaactcttgcagtttcttaaagtgatccttggacattccatcgtaatacttgtgtgccctctccttctcaagagcaagggctcgggtcaagtcttgtttgaacccatcattgattactgccttgtacttcaaaaccaggtcgtggttgttcttgatgatggcttctgctatttgcctagctttctccaaaagttcacttctgtctacaacataatttaccaaaccccatctctcagcttgttctgcgctgataggcattgcagttaaagatgcttcacgagctcggctgggtccaataacacgagagagttcttgagatggaccccaagaaggaaatatctcaaacctagcatgagtgtccaagaatttagcatcattagaggcaaccaacaaatcacaagcaagagaaatctcaaaaccagcagtcacagcaaatcccccaatagccccaatgata

SEQ ID NO: 835 - DNA, 483 bp, Nicotiana tabacum
cgggtggacgcagatgagtttcctctctgtaaatattttaactgtaggaaggcttgaaatctgcaatacccagcaactgcagataaatcgtcttatcctggaccaaaacatataaccagtggaggttgggtttctggaccgagaaatggaaggccttttatgttctttgttgccaatcatctttcttggcagttctgccctctttttttgtgcaattacataaatataaagaggctgacaccaaattttggttctagagcgtccatctgccatgcttttatttgatgcagttgcattgtaccttaaattcacttggttcctaactttagctttagtctgattcacagataagactagttcaagggtatattatcaatagtgttgcgagaaccgtgttttaccttctagccattatttgtgaaccaaattattcttgagagctaggaaaagaatactttggtttatgttgagatcccagggtgt

SEQ ID NO: 836 - DNA, 406 bp, Nicotiana tabacum
ggcaagaaagcatgtggagagggcaaccgatgatccaaaaatggttattgtaacttacgaaggagagcatcgtcatgtaattgaagggacgatcgccggcgccggagctggaagttccggcgagagaatgatggtgttcgattcaacggaacagagaaaaggataaacagcttagggatttaggggctcttttgtaatttcgaggtagtggaaagggtggaattgacatttggagaagactaaagagcagagaatagagatacggtgggtagggttttgtatgtaaatttggggaagattggggcagaaacgaaaaaaaagtcttttggggttgttaaaattttgactattttttattttatttaatacgaccatcgagaaggtttacaatttttaagtttgaaaa

SEQ ID NO: 837 - DNA, 184 bp, Nicotiana tabacum
cggcaccatgaaaccgctgtagaggaagagaagaaggcacaattacgaaaccggctttcgccattgacagaactgataaagcacgagatgcaccacttacgagtatagcttcattcctcagtaaatggcatgagctcctcgggtataatgtcagcggtccacacccggacacccccgcctccca

SEQ ID NO: 838 - DNA, 572 bp, Nicotiana tabacum
cggcgacgagcctatacgtgagaagatctttcattttagcagagaagctattttgaagctgaaattctgagccaacaacaaaatggcagttaacggtcaaaacggaaaaactaacgggaagatagcacccgttaacaacgagccggctttgcaaaacggtgcggctgtgaagggtacggcttcggagatttcatcattccaatcgttgagtgctcagttgtggagatccgtgacgcggaccaggaagttggacgggagcaaaacgacgacgtttaggatggcggtgaactgtcgccatcggctcgagcaaaagatggagccgctgtattttggaaacgcgattcagagtatcccaacggttgcttccgttaatgagctgttaactaacggcttgaattggagcgcgaatctgctacatcagaatgtagtggcgcatgatgatgctaccgtgcgccggggtgtgaaggattgggaaagtaatcctaggttatttcctttgggaaatttcgacggagctatgatcactatgggaagttcacctagatttccaatgtacgataacgatttcgggt

SEQ ID NO: 839 - DNA, 251 bp, Nicotiana tabacum
cggggcattgaagtcaccaaacggagacgtcggagttgacggaatgataagcgtgataggtcacgaactagctgaactatcatcaaatccgttagtgaatgcgtggtatgctggggaagatccggttgcgccgacggagatcggagatttgtgtgagggattgtatggtatgggcggcgggggtgtccggggtggacgtcgtgaaggaggcggcggatacggaggtggaggatatggaggtggaagacgcg

SEQ ID NO: 840 - DNA, 591 bp, Nicotiana tabacum
cggccaatggcttctatacttatgatgcattcatagctgctgccaattcctttcctggttttggaactagtggtgatgatactgcccgtaggaaagaaattgctgcctttttcggtcaaacttctcatgaaactacaggtggttccctgagtgcagaaccttttacaggaggatattgctttgttaggcaaaatgaccagagtgacagatattatggtagaggacccatccaattgacaaaccaaaataactatgagaaagctggaaatgcaattagacaagacctagttaacaacccagatttagtagctacagatgctactatatcattcaaaacagctatatggttctggatgacaccacaggataataagccatcaagccacgacgttatcatcggtagttggactccgtccgccgctgatcagtcggcgaatcgagcacctggttacggtgtaattaccaacattattaacggtggaattggatgtggcgtaggtccgaatgccgcagtggaagatcgaattggatactacaggaggtatcgtggtatgttgaatgttgctcctggggacaacttggactgttaca

SEQ ID NO: 841 - DNA, 567 bp, Nicotiana tabacum
cggcgacgagcctatacgtgagaagatctttcattttagcagagaagctattttgaagctgaaattcagagccaacaacaaaatggcagttaacggtcaaaacggaaaaactaacgggaagataacacccgttaacaacgagccggctttgcaaaacggtgcggctgtgaagggtacggcttcggagatttcatcattccaatcgttgagtgctcagttgtggagatccgtgacgcgggccaggaagttggacgggagcaaaacgacgacgtttaggatggcggtgaactgtcgccatcggctcgagcaaaagatggagccgctgtattttggaaacgcgattcagagtatcccaacggttgcttccgttaatgagctgttaactaacgacttgaattggagcgcgaatctgctacatcagaatgtagtggcgcatgatgatgctaccgtgcgccggggtgtgaaggattgggaaagtaatcctaggttatttcctttgggaaatttcgacggagctatgatcactatgggaagttcacctagatttccaatgtacgataacgattt

SEQ ID NO: 842 - DNA, 183 bp, Nicotiana tabacum
cggcaccatgaaaccgctgtagaggaagagaagaaggcacaattacgaaaccggctttcgccattgacagaactgataaagcacgagatgcaccacttacgagtatagcttcattcctcagtaaatggcatgagctcctcgggtataatgtcagcggtccacacccggacacccccgcctccc

SEQ ID NO: 843 - DNA, 483 bp, Nicotiana tabacum
atgggtcatttacaccagacgcgatggatccatacacagacaaaatgaatatctggcagaaaatcgacaactggttatcagttttgtacattaagccctcgctctggaagatacacgagaaggcggcgagagaccatttcagggaaacatacggccccaaatatgaagcccttgttgatggatgctggacaaatatcagcctttcaatgatttcatcaaactttttgtactactatccgcgtcttcacggcccaaatgtcattgaattgggacctctgcatttgaatgatcaccagcaaaactcccaaagaatctgcaagattggttggacggggcagaaaaaggagtaatctacttcagtcttggtagcaacatgaaaagtaaagccttaccagaaaatgtgcgggaaaactttctgagatttttcagagagctgccggctggttacaggtactgtggaagtgggagctcgatggcaaaata

SEQ ID NO: 844 - DNA, 229 bp, Nicotiana tabacum
aacatcatcacaccatttatttatatttatagcaaatgctagtcagtgaaagctatttcaaacacaaccacaacatttatttaacatgcagttcccaacactctactgtatcaccccggaaggaaacaaactggcaaacatacataaaccgcttctcaccaaacttatccaggtgtaatcaggcacacagcactattactataaaacaccatcacaagaaaacacaccc

SEQ ID NO: 845 - DNA, 442 bp, Nicotiana tabacum
  modified_base (430)..(430): a, c, g or t
atgggtcatttacaccagacgcgatggatccatacacagacaaaatgaatatctggcagaaaatcgacaactggttatcagttttgtacattaagccctcgctctggaagatacacgagaaggcggcgagagaccatttcagggaaacatacggccccaaatatgaagcccttgttgatggatgctggacaaatatcagcctttcaatgatttcatcaaactttttgtactactatccgcgtcttcacggcccaaatgtcattgaattgggacctctgcatttgaagacaccagcaaaactcccaaagaatctgcaagattggttggacggggcagaaaaaggagtaatctacttcagtcttggtagcaacatgaaaagtaaagccttaccagaaaatgtgcgggaaaactttctgagattcccccagangagctgccggct

SEQ ID NO: 846 - DNA, 204 bp, Nicotiana tabacum
cggggtcaaccgaggatcaggtggggagccttgacgagggataaaactcaggagttggaggggaggttgatggttatgggcgcctggaggagtagcggggacgctagcgagatgtggacagctactgcagactgtataagaaaggcggcgagagaggtactaggggtctcgaagggttactatgccgggcacccccgcctccca

SEQ ID NO: 847 - DNA, 408 bp, Nicotiana tabacum
cggcagcaacagtgagaccgattgttagggcagcgacggcttgagtgtgttgtctgttggcgtcacagactccgaaaacgacgaggaccaaaatgaatccaagaatgaattcgattccgagtccttgaacttcagtcaagttagcattaagggaggtaactccgaatccgccagtgtaaggagatggatgtcatgccttaaggagatgcagatccagcaatagcgccaagaacttgaacgacgatgtagaggaaagctctgatcagtgtcacttttccggcagcgagaagtccaacagtgatggctgggttgatgtgagctccacttacgtgacccaacgtgtgaacgagggcgaagacgattgaaaccgaaagtgagggcaatgaggactagattgggccggacacc

SEQ ID NO: 848 - DNA, 190 bp, Nicotiana tabacum
cgggaatgctttggagtgcgtagtatagtgcgcgtcagcctacccaactctgtatgcatagataccaggtatatgctgggtctgtgtccagagtagcatgaacaggcctttcctgtttgttgaagtttacctcatatgtcaattgcaagcaggaaccttgagttgagacatcagagatcgctggtatata

SEQ ID NO: 849 - DNA, 291 bp, Nicotiana tabacum
accctcatgcaggcgcccaatcgaatcggtcaaaacgctaacccagctcgaagaccttaaggttttaaagcatccgttgcactcttttccttcgaccaagttcttatctcgaaaaagggtttttaccggcaaggattttaacgaggcaacatctgcatgctacctaagggaaactcaagaaacaccctggaagccacccgctcgaaaaaaccaagaaatgccgaacgggttctcctataggaaagtaatgtaccagtgccaaacagtcaaacgaaccgtgtccatatggcc

SEQ ID NO: 850 - DNA, 259 bp, Nicotiana tabacum
ttttgacaagaacagaagcagtgttgtgcttctaaatatttatgcacacttcaggctgctttagattgcacaataaaatcaacaattattaccaaaatttcacaatttgggtgattattgcaaccttgcataatccttattatcaacttctatgccatccaaatcccctacaaataaatatatcaatagacacgtgccttgggtgggaatgtctcgacctcgtcatctagagtgttcatatgaactggtctgtactcta

SEQ ID NO: 851 - DNA, 278 bp, Nicotiana tabacum
gtgctggtggtggctatggagctcagccgatgcagtaccaaaatccgcagatgcagggcggtgcaagaccacagggtggtgcaccttacccaggctatggaggtcactaggaaagcttaaggtgtgatctccctctcatgcattgcatgttggtgtctaatgcttatagagttaaattagctacagggcaatattgtactctacatgaaatttcttacaatggactttagtggttcctttgattaatgatcagtttgcctttattgcattgctaaaaa

SEQ ID NO: 852 - DNA, 547 bp, Nicotiana tabacum
ggggagcagaacttggggaaggtccagcagtgtttgcagttcctgagctattggcaggccctgaagatgaaacaggatgttttctctttctcccagtctggttttttgaagcctgatcatttccccgaaaagaatttgacatgcttccatctcctgcaacactgccagggccaataattttatcttgttgcagactgtgatttgaactctgtggttgcggaccagaaagtgtgtgttgaggaagctgctgctgttgcgacagttgtggattaccagtatgctgttgctgctgctgctgctgctgctgctgttgctgttggaattgggccatcctcaacttgagcaaaatatcttgtggaggaccaggaccctgtgaagctgaactcatatttggaacaacatcaccaacagaatttgaaaggccatctttgcccatactagagttccgattactaaggagcattcgtagccttctgctttcgacgtactagcagatggtgaggtcagttctgctgtgctaggataagttgctgctggtgttgaggtg

SEQ ID NO: 853 - DNA, 233 bp, Nicotiana tabacum
ggtgtgttttcttgtgatggtgttttatagtaatagtgctgtgtgcctgattacacctggataagtttggtgagaagcggtttatgtatgtttgccagttgttccctcccgggtgatacagtagagtgttgggaactgcatgttaaataaatgttgtggttgtgtttgaaatagctttcactgactagcatttggctataaatataaataaatggtgtgatgatgttttaaaa

SEQ ID NO: 854 - DNA, 247 bp, Nicotiana tabacum
gtgtgtttgcttgtgatggtgtttgatcgtaatagtgctgtgtgcctgatatacacctggataattttggtgagaagcggttcatagtatgtttgccagtgctcgtttcctgtccggggtgatacacgtacgagtgttgggaactgcatgttacaataaatgtatgatggtagtgtttgaaatatctatacactgactagcattgtcgctataaagtataaataaatggtgtgatgatgttttaaaa

SEQ ID NO: 855 - DNA, 204 bp, Nicotiana tabacum
cggggtcaaccgaggatcaggtgaggagccttgacgaggaataaagctcatgagttggaggggaggttgatggctatgggagcctggaggggtagcggggatgctagcgagatgtggacagctacatcagactgtataagaaaggcggcgagagaggtactaggggtctcgaagggttactatgccgggcacccccgccgccca

SEQ ID NO: 856 - DNA, 301 bp, Nicotiana tabacum
accagcttctacaagatcaggaagtgacaagacagaagcagtgttgtgcttctaaatatttatgcacacttcaggctgctttagattgcacaataaaatcaacaattattaccaaaatttcacaatttgggtgatttattgcaaccttgcataatccttattatcaacttctatgccatccaaatcccctacaaataaatatatcaatagacacgtgccttgggtgggaatgtctcgacctcgtcatctagagtgttcatatgaactggtctgtactctagccggacaccccctccgccca

SEQ ID NO: 857 - DNA, 184 bp, Nicotiana tabacum
cgggtgtggaccgctgacattatacccgaggagctcatgccatttactgaggaatgaagctatactcgtaagtggtgcatctcgtgctttatcagttctgtcaatggcgaaagccggtctcgtaattgtgccttcttctcttcctctacagcggtttcatggtgccgggcaccccctcctccca

SEQ ID NO: 858 - DNA, 235 bp, Nicotiana tabacum
gtcatcgggttacgccgaaaaaagtctacgagttatgccggaaaggtcctctggttatgccaggaaaagtcaccaggttatgccggaaaggtcctcgggttatgtcggggaaggtcatcgggttatgccagaaaggtcctcgggttatgtcggggaggtcttcgggttatgccggaaaaagtccacgggttatgccggaaaggtcctcaagttatgccgggcacccccgccgccc

SEQ ID NO: 859 - DNA, 405 bp, Nicotiana tabacum
ggtgcccggcagtatagttctgagctacttcaatctgaacttgagaggactagaatcaatacagcatgctttgtggaatcaattcccctggactctgttccagaatcggctaaggcagcatatgcttcttttagaggacctatggattctcccactagaaattttaggggatcacaacatattggatccccaagtttctccaggccaagacgtagataaataagtatccatttcttttctgtcagtttttcttatgtaatgcttgtgcagttgttgtattttagcagtttctacattcttttgttagaagaaagaattttgctgattcattcatgtacgtagaattgaagctgttttccgccagtacggtttcaaaagattttatgcaattttctttatataaaa

SEQ ID NO: 860 - DNA, 298 bp, Nicotiana tabacum
gtgtccggcagtggcttttgacttgcctttttaattccgtcctccgctgtctcaattctttctcttcattttatcctatcatagataactgcctttattttatgcttatgtaaatatgtctaggaagtgaagtttctttttattcgaagaaggtaatatgtaatcatgtacgtatgtgtgtttctctacttggtccataatttagcgaaatagctgttatgttgcacgcacatgtgtgtataatggactcaaaatgagggaagagggaagacagatcataacattttgctgataaaaa

SEQ ID NO: 861 - DNA, 375 bp, Nicotiana tabacum
ggtgtccggcacgatcaaacagtggctgatttcatgtgattttattaggtagtaccccactaaaattatgcttagttcggttttggactcaaactgcaaactaaggtgtggctatggggtgtacctaaagcacaaccatttgaggtctttccataatgtatgtggtcctacttgagagttctgttatcttgttctattagatattagtgatatgtgtggccagtgatggcgtaacattcatttatgttagtgtttttggtgttagaggagatatagctcaagttggactggttggcatatactgtgtattgccaaaatttggttgttatgggcatgctatatcagtttggcaccatttttatgttggcgctaaaa

SEQ ID NO: 862 - DNA, 406 bp, Nicotiana tabacum
ggtgcccggcagtatagttctgagctacttcaatctgaacttgagaggactagaatcaatacagcatgctttgtggaatcaattcccctggactctgttccattaatcggctaaggcagcatatgcttcttttagaggacctatggattctcccactagaaattttaggggatcacaacatattggatccccaagtttctccaggccaagacgtagataaataagtatccatttcttttctgtcagtttttcttatgtaatgcttgtgcagttgttgtattttagcagtttctacattcttttgttagaagaaagaattttgctgattcattcatgtacgtagaattgaagctgttttccgccagtacggtttcaaaagattttatgcaattttctttatataaaa

SEQ ID NO: 863 - DNA, 534 bp, Nicotiana tabacum
caagtcgttcacaacccacttttgacaaagaacacaagtcgttcttagccaacactaagacctgcccacgcctagccttagtccattttgaaacactttgaaaccctcacgtttcactcttgtttcccacttagaatttcacataaaattgcacacaccaatctgactaagtccaaaggccctatttatagcacataggcagcctttaggacttgacaacacattgacacttattgtctatagcttttgccacttgtcgggctaaggctaaatcagttcctaacttgtagttgacatccccaaatgcttaggccatgttatgcgcgaaattataatggatacaagcataaatcagtcatgggtacaagaggttatgaaaaggtaaccgccaaactaccttggcatgtgcattgcatgtgccatcttgacttggccagctgattcacgcccaaggctggcattgcgcccaaccttggctcattttgacattgctccgcaccaatgccttgcccgcaatccgccgcccatgatttt

SEQ ID NO: 864 - DNA, 277 bp, Nicotiana tabacum
ttttttttttttttttttattgaagttcctttagtataaagaagctgaatttggcaaaagcataaaagacatgatatggaaatatcacaatacgtgtgcagtagttaagcactgggcatgtattaccatacatatagagacatgacttcctaaatacaaaaggtaatttaattatgttgccgattttaatgattcaacttgagattttccagaaggacctttggttctgattaaagctcgatactcattaaacgtcgccggacacccccgccgccca

SEQ ID NO: 865 - DNA, 327 bp, Nicotiana tabacum
taggctaacaactactaagcttagttcatgagaacaatgcagccgctaatgcagggaggagaatacagaagagaatcaacagttaccagccttactattagagcatccaagtatgtgacctaaaggtcgatgaagtaggtgcaaaccatgaagaattgaaaatcatagtagaaaccccatcagagacaaagcactaggcttcacatctgcctaagtctcggtgggcaaagttacacaacacctgttctagtcgaggtagcaaggtagcagatacccggtgggaatagccgaggtgcgcacaagctgcccggacacccccgcctccca

SEQ ID NO: 866 - DNA, 355 bp, Nicotiana tabacum
ggtgcccgggtagcggttcctcacaggcagtggcgaatcgcttcagtagtttctaattattctcctttggctcatggaagggtcctaaggtattcttttcttataggaatttctttcttaggaactttttgttctcattagcttgcctttcttggcttgtactattctgtgtcagttggtcttttgtagttttttaacagttgtcactattagtgtcttaaatagagttatatagtgtacttttatgatgtccagattgttggttaggaggtaatataccactcttggcaaacacctcatttgtatttgaactgcacagttaattaccatacaaaatgaatgttgaaggttaaaa

SEQ ID NO: 867 - DNA, 443 bp, Nicotiana tabacum
ggtgtccggccccattcaagcagttccttgaggcagtgacaaatatgaaatttgatgaggaaccaaattatgccaagcttatctctttctttgttattcttattgagccagtcacgtcactacgaccaataagaattggagctcttaaggttgggcagaagcggggaagattgctaataaacttggaggaagatgagcaaccaaagaagaaagtacgattaggtagtcctgcaacacaatggatttctgtttataatgcacgacgtcccatgaagcagaggtaccactataatgtagcggactctaggctccggcagcatgtagacaaaggaaatgaggacggtctttacatcagctgtgtggcttcagcagccaatctgtgggccttaatcatggatgcaggaaccggtttctcttcccaggtttatgagctttcagctgta

SEQ ID NO: 868 - DNA, 613 bp, Nicotiana tabacum
  modified_base (547)..(547): a, c, g or t
  modified_base (576)..(576): a, c, g or t
  modified_base (607)..(607): a, c, g or t
gttcaagtggaagagaattatgcagagccattgcactttggaccatacctctcaaccctctcatcaatccaagctctcatatcagctaaaacaagattggcagcatcatcaggctccccttgaatcaacgagtgatacattccatcgtaaagcttgagggatttgtccttgctgcttgccttttcgtacaacaacttcgagcctgtagggcatgtaacaccatcagatgtcccgtgcactgtcaaaaatggagcagtgaccttgtggaaattgttctggacgtattcacactgcctggcaatctccctcatagttcccacccttggcttcccggtatatctcctgggattgcttgcgattattttcagtttctcagtgtctctgatagccttgcccaccatcttgttgtccggcattgccgcccacgtatcagcaaatccaaatagcaacccatacatgaataaatgtaccttagaaggcttcataggctcaggaatgacaaaaagcggggcggagaagatcaaccccggtccaagtatctgggctncgattgaaagtacataagccaagtagctnacccacccattgattccccggacacccccgncggcca

SEQ ID NO: 869 - DNA, 349 bp, Nicotiana tabacum
ggtgtccggcatggacttagaacgattcaggtcacgtggagagacgataaccgctattcccggtggtgcctccggctgcgggagcaagttatgtggctggattacccctaatacgttgccgttttctttaactgaatcgttttcgttgtaagagacagctgaatttatatcttgcggtcctccgtgattaacggaattcaaaatattttctgttagagtattaacgggatttgaaatcgttgtcacgtgaccttttgaaacagaatcattgtactttccattttcgttggaaataatatcttcttctgctggtaagtaatactcatcccccggacacccccgcctccca

SEQ ID NO: 870 - DNA, 494 bp, Nicotiana tabacum
  modified_base (411)..(411): a, c, g or t
  modified_base (415)..(415): a, c, g or t
  modified_base (428)..(428): a, c, g or t
  modified_base (446)..(446): a, c, g or t
cggccgaagaagtaccagcaagacaccgaagacttcgtagtgcccgactcggacgacgatgccacgcccaaaacgccccggaagcggcggaaattaaacgacgcgaccacccctacatcgtcaaggaagagtccggccactcgaaagttcctgacccctacacacaaacggatagtgatcaagaagcagttagagtttacccctctgggcacgcgtgtcctatctccctcggccctcaactctccatttcagattgctcggaatcagttgcatgtatcttcggtacccgcagcactcccatgtcgtgaggaggaattctcgaccgtctacagtcacctggaggccagccatcaccgatggatccggatcctgtatttacatctctggtaccccgggcacccccgccgcccnaatncactagtgaattncgccggccgcctgccaangtcgaccatatgggagagctcccaacgcgttggatgcatagcttgagt

SEQ ID NO: 871 - DNA, 196 bp, Nicotiana tabacum
cggcaagtacagatggtcaaattattggaggcggagttggtggtcccttgatagctggaggcccaattcaggtgattgttggctcattttcagttgactcaaaagctggtggagtaaagaatgatatttctcagcaaattggtgggtcaccaatgtcaagtgtaggctttcgctcggtggttgattcttctcaatc

SEQ ID NO: 872 - DNA, 278 bp, Nicotiana tabacum
cgggccgcagaatatgtgaaacacgatcttttcagcaacctgataaggcatccaaaatttatatcagacaccaaatcagcaatagccgatgcatacagccatacagactctgaatttctgaaatcagaaaacaatcagcacaaagatgctggatcgactgcttccactgccatccttgtaggtgatcgtttactggttgcaaatgttggtgattccagatgctgttatctgcaggggaggcacagctattgctgtttctcgagaccacaagcctgaca

SEQ ID NO: 873 - DNA, 178 bp, Nicotiana tabacum
cggggcgtaagtcccgactgccgaggtgtaagtctcacggaactaagccccacacataagtcccggggcgttttacgagtgctccgctccagggcgagccccgggcgagtcccaattctgccttttaaaacagagctaattactatagtacaaagtaattttattctgtgcagtggaa

SEQ ID NO: 874 - DNA, 629 bp, Nicotiana tabacum
  modified_base (515)..(515): a, c, g or t
  modified_base (540)..(540): a, c, g or t
  modified_base (559)..(559): a, c, g or t
cggcacagcgaggacatcactaccgagaagctccgtgaggagatcaaggagaagatcatcaagcaggtcatccccgatgaagattgcttgattgacaagaccgtctaccacatccaaccttccggtcttttcattcatcggtggtccccagggtgacgccggtcttactggacgtaagattcatcgttgacacctacggtggttggggtgcccacggtggtggtgctttctccggaaaggactactccaaggtcgaccgttccgctgcctaccttgcgcgctggatcgccaaatcgctcgtgaacgccaagctggcccgccgcgcactcgtgcagctgtcatacgctatcggtgtcgccgagcccctctctctcttcgttgagacatacggtacctccgacaagtcctcggacgatgctcgccgagattgtcaagaacaacttcgacctccgccccggtgtcattgtcaaggagcttaacctcatcaaccccatctacttccagaccgctaaganacggtcacttcaccaaccaggagtncacctgggagaagcccaangagctcaagctctaattttaatgccttttgcatacagtgcgcatgaatcaacttcatcgcacatcaagat

SEQ ID NO: 875 - DNA, 230 bp, Nicotiana tabacum
tttttacaaaacgagcaagctcttaaaaatatataccagcaatctctaatgtctcaactcaagttcctgctgcaataaacatatgaggtaaattcaacaaacaggaaaggcctgttcatgctactctgaacacagacccagcatatacttggaatctataaatacaagttaggtagctgacgcgcactatactcgcactccaaagcattcccggacacccccgcctccca

SEQ ID NO: 876 - DNA, 283 bp, Nicotiana tabacum
cgggctaagtctgaagcaaccaacttcgaaagtgcatatggtgagccaattccggtgaaagaacttgcggaacgcgttgctagttatgtgcatttatgcacactgtattggtggctcaggcctttcggatgtggggtgattcttggaggttatgatagagatggacctcaactatacctggttgagccttctggtgtctcatacaggtactttggtgctgctattggaaagggcagacaagctgctaaaacagaaattgaaaaattgaagttatcggagatga

SEQ ID NO: 877 - DNA, 267 bp, Nicotiana tabacum
cgggtcgggtcgaatggcttgcagcagttgtggaggttcaggtacgggtcgtccaattccggtccaaatctccgttcgtcctcccaaccgctcaatttagaacctcggttcgtttttaactctgtaacagtcccatgtataatatctttgtagtacttatttcagattcttgaggttggaaaaagatacaaatttttatgtatttgtatatgtttggtggtacttgagagttagccttacatgggaattacttgttctatgctgtaa

SEQ ID NO: 878 - DNA, 205 bp, Nicotiana tabacum
cggggtgatgaattcaagggttacgtattcaagattatgggaggatgtgacaaacagggtttccccaatgaagcagggagtttaactccaggccgtgttcgccttttgctgtaccgcggtactccttgtttccgggggtatggtaggagaaatggtgagcgcagaaggaagtctgttcgtggatgcattgttagccctgatctta

SEQ ID NO: 879 - DNA, 316 bp, Nicotiana tabacum
tgcggacaaacaccaagaatcagttatattaggttgaaggaactaaaagtttaaagcaacaaatcaaatactcatgttcaacagagagttacaaactcataacatttaaccaaaccatgcgtttaagttcggaatgaaactgaaagtattgagataagataaaatgaaactttgcaattacttgactgcttctttcaaaattcaaacaaggatggacctctgaccggggccaggaccgttaaacgaaaactcatcggcgataacgacagtacctcgacttgtagctgaatggagtcccggacaccccctccgccca

SEQ ID NO: 880 - DNA, 228 bp, Nicotiana tabacum
tttacaaaacgagcaagctcttaaaaatatataccagcaatctctaatgtctcaactcaagttcctgctgcaataaacatatgaggtaaattcaacaaacaggaaaggcctgttcatgctactctgaacacagacccagcatatacttggaatctataaatacaagttaggtagctgacgcgcactatactcgcactccaaagcattcccggacacccccgccgccca

SEQ ID NO: 881 - DNA, 222 bp, Nicotiana tabacum
aaacgagcaagctcttaaaaatatatactagcaatctctaatgtctcaactcaagttcctgctgcaataaacatatgagataaattcaacaaacaggaaaggcctgttcatgctaccccgaacacatacccatcgtatactgggaatctataaatacaaattaggtagctgacgcgtactatactcgcactctaaagcattcccggacacccccgccgccca

SEQ ID NO: 882 - DNA, 522 bp, Nicotiana tabacum
aactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgctttttcggatacctgtccgccttttctcccttcgggaagcgtggcgctttctcatagctcacgctgtaggtatctcagttc

SEQ ID NO: 883 - DNA, 325 bp, Nicotiana tabacum
cggtatccttatggagtacatgaacgtcggcacactagaaagtcttttaaaatcacaagcaactttctccgaacttagcttagcaaaaatcgctaagcaagtacttagcggactcgactacttacacaatcacaaaatcattcacagatttaaaaccttcgaaccttctagtaaaccgcgagatggaagtaaaaatcgccgatttcggagtgagtaaaatcatgtgcaggactttagatccttgcaattcatacgttggaacttgtgcttatatgagcccagaaaggtttgatccagacacttatggagttaactacaacggtta

SEQ ID NO: 884 - DNA, 286 bp, Nicotiana tabacum
aggttgaaggaactaaaagtttaaagcaacaaatcaaatactcatgttcaacagagagttacaaactcataacatttaaccaaaccatgcgtttaagttcggaatgaaactgaaagtattgagataagataaaatgaaactttgcaattacttgactgcttctttcaaaattcaaacaaggatggacctctgaccggggccaggaccgttaaacgaaaactcatcggcgataacgacagtacctcgacttgtagctgaatggagtcccggacacccccgccgccca

SEQ ID NO: 885 - DNA, 393 bp, Nicotiana tabacum
tagggacagaacacttagctttatacgtcgtagccaccaagtaggctttatttgtaacctactttatctcttcctagggttattcccttacatttgctcactgtgcttttatgtgctgttcatttcgtgagtttatgaggttgattgtcttcacttcctcacatgtttgagtttgactccattttattcatttacttaaatatgattatatgttagtttttacagttagattaatcacctcattatactgctgttagtttgggctcttttgagtttgttaattgatcagctttatcactttgtcgtgatactctgcgggttagctcactcatgctgtgggtcatagacgttttcttcttgttactccgttatattgacttagaccggtcacac

SEQ ID NO: 886 - DNA, 534 bp, Nicotiana tabacum
ttttgcacactttggtaattagggctttggccattacaagaaaaacaaacctttgaatatacaaaatatcaaccgatgcctaagaataaaaaaaaaaagagggtgggggtgcaagcactatcactcacttacaaaagcttcacattgtgaaataaacagaaaaaatgaaaaaagaaaaaaataaacaaacaaggatactccctaaaaaccgcatccatgccatgtgtcatatagtttagaataataaattcaactttttttcaggctttttcttttttctaattgagaataatattgtagtataaggttaaagttggggtttaccgagtgtgtatgtgattttttgttggtttctttgtaggaaatgaggtggttttccatattttgacacttgggaaaatccaaacaaccaccttttgttggcggggttagttagctttgctaattactccacgtccttgtgaaaatgctctttagcctattgccggaaagtctctgccaagccttcttagccccggacacccccgccgccca

SEQ ID NO: 887 - DNA, 405 bp, Nicotiana tabacum
catcaagcaaaagaggaaacgaaagcaatccacgccaaaactctcaaaccacactttatttttattgtttaaccttctttccagacgtatataggaagatgcttctcacagtatattctgcagtcaagcaaacctattccgcgacctgtgcactagctgcctccatcaggccgttgcgtatctgatcaccaatgtcacgaacatggccaggaccatgtggtatgaaaactgtcgtgttctttgaggagtttccaaggtctttgatggtgtcaaagtactgggtgatcattataagatccatcacttctttagcagaagtgccttctactttatgtgagaagttcaagatgttttctctcaaaccatctgtaattgcctgcctctgccgggcaccccctccgccca

SEQ ID NO: 888 - DNA, 419 bp, Nicotiana tabacum
cggggtacttaacagtgtaagtagcagtagacagtgaaagagattgtgacttcctggttagtaacaattccagctggtgctacctttgcagttatctacacatggatattcactaagctcttatcatacatactctgagtgtaaattaacagaaaacgccaccactcaaacttcttggattaattataaaatcacacagataacgtttctgtcgtgatttgagaaatgcaatttttgaaccttgtggaggatccatgatcaagagtagtagtccattcagttaggaagacgaacaagctttggtttctgcctagcacttttgtgttggatttaagcaaatgtgattttgtttctttgtattttacttccatatcaggttgttgatcttagatattaaagtttgaaactgttcttcaaaa

SEQ ID NO: 889 - DNA, 348 bp, Nicotiana tabacum
taccatcctgtgtgctgaaaatccggataagagtacccttgatacttgctgttgccagcacatgtccctcatgactaagtgcaaaagatgcagtcttagaatcatgcgcaaaaataaacttagtcctttttgaagtgaaatgctcaacacgaacttcaccatttcgtaatccagggcacaccagcacaggtgatccagccgcttgtgaaatctcacagagtccctttgtgtttacaattgtctcaatctggtggacgagcttcatgtcagcaaaattatatataaatatcttctgctcaagtataactacgatgcagtcacgtcgaagccggacacccccgccgccca

SEQ ID NO: 890 - DNA, 654 bp, Nicotiana tabacum
  modified_base (544)..(544): a, c, g or t
tttcaaaaggaaaaaaatggatttagcctaaagggcaaaaggggggatcaccaagaatctggtggcaaaaagtcccctcctagtttatggtttacattactctgattcacaaagacatgtatagcgctagcacttataacttgtctaaaattctaccacctattaatttcatccgataaacggtcatttacaacaaatagtatataaagccagatacctgctttatatgattttgcatatattgatgtatggcgactttcaactccaataagttagagtaactaccaacgcagccggtgaactttctacacgttccccaattttgcactcccccaggaaaacctaatcagccgagtaagttcacaaaacaccagagtccaaagctttgattgttttgcgtcgccacatagcagttcctggatcaaacctcagctcccatgttggccagtaatgtaaatcctgcttcaatgtaagtactcgaggcttcccattcaggtggactgttcgtacccggacaccccctccgcccaatcactagtgaatncgcggccgcctgcaggtcgaccatatgggagagctcccaacgcgttggatgcatagctgagtattctatagtgtcacctaaatagctgggcgtaatcatggtcatagctg

SEQ ID NO: 891 - DNA, 609 bp, Nicotiana tabacum
aaccgagtaaatctaatcttattccaattccaacatgcactggtagtagtaaacaccaccaattacagtaaagacccgacacagtacgcccgaaacccgacccacaatctcaaaaaggaaaaggctaaaaaaaaaacgaaaaccagcaaatcagtacactgcgatcacatagttaactagactagatcatcattaacattaattgatacgattaataatctaagagagttgaccacagtcagcaatcacaacgggcttcgagcacctgccggagctagatccaacggcttccactttcttaatcacgtccattccttcaataacttgaccaaacaccacgtgtttcccatcaagccactcggttttggccgtacaggtgaaaaactgagatccgttagttccaggtccagcattggccatagagagaattccaggtccagtatgctttttaacgaaattctcgtcggcgaatttggcgccgtagatcgattcaccgccggtaccgtttccagcagtgaaatcacctccttgacacataaatccaggaatcacacggtgaaatgatgatcctttgtagtgtaacggcttgccggacacccccgccgccca

SEQ ID NO: 892 - DNA, 425 bp, Nicotiana tabacum
ttttgagcaacaacaagaaagcttgctggtacttttacttgtataacatatccattatatgaaatatgtttagatccaaggctatccactgtgaatgaggggattgaattactccacatggaacgatagaaagattcacacggattgagaagcaagatgaacaaaaacaaaagtataacggaaactgtaagaagtcaaagtgcactctgtttcatccatgtcattcatcaaactcatgcatatgatccaagatgatagtttgcagccagctcctcatttttgttgcatgcaaaaaatacttgcaaaaccaaagctcgatcgaaacccatagcttcaagtcgttcgatagcctcgcgctcttccggtgtgacagtcacagcttgtggtatcgcccctgctggctgcccgggcacccccgccgccca

SEQ ID NO: 893 - DNA, 277 bp, Nicotiana tabacum
ttttaaagcaacaaatcaaatactcatgttcaacagagagttacaaactcataacatttaaccaaaccatgcgttaagttcggaatgaaactgaaagtattggattaagattaaaatgaaactttgcaattacttgatctgcttctttcaaaattcaaacaaggattggacctctgaccggggccaggatccgttaaacgataaactcatcggcgattaacgatcagtacctcgatcttgtatgctgaatggatgtcccggacaccccctccgccca

SEQ ID NO: 894 - DNA, 594 bp, Nicotiana tabacum
cggcttgctaatatcggagatcaagaagaaaacgcttgtcccacagcagtggtgcaatcccgcagtgatctcgacaaaggtatagcagtctacttcaaacctaaagagcccaaacatcagcagattgtggagtcttcttcgttaaacatcaatttctattttgatagtaataagtgtgctaacctaacagtgtggaaggtagacaactaccctatacctcgaaagtacagcacaataagcacaggtgcaaagttgggaaatcccctggatgtgaatagctggtttcaaattaagcctcttggtggctcgacgtataagctagtgttctgtccctacggagaggagtttacttgccaaaatgtaggcatcactgaggaaaatggatataggcgtttggttctcacagagaatgcaaaggcctttgtgttcataaagcatggcggattaggaaaggccgaagcatgattatgcatctgctttctaataaaactaagttgtgtaaaacatgtattaatgcaggccctgcattcggtgtttcactggatgtaagaataaataatgtaatgcagccctaataagtgccctatgcatgct

SEQ ID NO: 895 - DNA, 457 bp, Nicotiana tabacum
cgggctaagtctgaagcaaccaacttcgaaagtgcatatggtgagccaattccggtgaaagaacttgcggaacgcgttgctagttatgtgcatttatgcacactgtattggtggctcaggcctttcggatgtggggtgattcttggaggttatgatagagatggacctcaactatacctggttgagccttctggtgtctcatacaggtactttggtgctgctattggaaagggcagacaagctgctaaaacagaaattgaaaaattgaagttatcggggatgacctgtcgacaaggggtgattgaggtggccaaaataatttatggcagtacatgatgaggcaaaggacaaggcatttgaacttgaaatgagttggatatgtgacgagtcccaaccgccaacatcagaaggttcctgatgatatttagaggaagccgaagactgcagctaaagctgc

SEQ ID NO: 896 - DNA, 295 bp, Nicotiana tabacum
cggcggcggtgtaggaggagaaatcatgctgtttggtgtgagagtaaaagtggatcctatgaggaagagcgtcagtttgaacaatctctcacagtacgaacagccaaatgctaacaacagcgctgatacatctaaagtggctgaggaaggatatgcctctgcagatgacgctgttcaacaccactccaacagcggtcgcgagcgtaagcgaggagtaccatggacggaggaagagcacaagttattcctattaggattgcagaaagtggggaaaggagactggagaggaatctca

SEQ ID NO: 897 - DNA, 140 bp, Nicotiana tabacum
cggcttgctaatatcggagatcaagaagaaaacgcttgtcccacagcagtggtgcaatcccgcagtgatctcgacaaaggtatagcagtctacttcaaacctaaagagcccaaacatcagcagattgtggagtcttctta

SEQ ID NO: 898 - DNA, 202 bp, Nicotiana tabacum
cggggcgtaagtcccgactgccgaggtgtaagtctcacggaactaagccccacacataagtcccggggcgttttacgagtgctccgctccagggcgagccccgggcgagtcccaattctgccttttaaaacagagctaattactatagtacaaagtaattttattctgtgcagtggagcatgaagtactcgaaagagaaagg

SEQ ID NO: 899 - DNA, 529 bp, Nicotiana tabacum
gtgccggggctaagaaggccttgcagagactttccggcaataggctaaagagcattttcacaaggacgtggagtaattagcaaagctaactaaccccgccaacaaaaggtggttgtttggattttcccaagtgtcaaaatatggaaaaccacctcatttcctacaaagaaaccaacaaaaaatcactacacactcggtaaaccccaactttaaccttatactacaatattattctcaattagaaaaaagaaaaagcctgaaaaaaagttgaatttattattctaaactatatgacacatggcatggatgcggtttttagggagtatccttgtttgtttatttttttcttttttcattttttctgtttatttcacaatgtgaagcttttgtaagtgagtgatagtgcttgcacccccaccctcttttttttttatcttaggcatcggttgatattttgtatattcaaaggttgttttcttgtaatggccaaagccctaattacaaagtgtgcaacttgttctcttcaaaa

SEQ ID NO: 900 - DNA, 590 bp, Nicotiana tabacum
cggggcaaatgcgtcttcttctattattcttaccgctggtattgctgaggttgctgctggtgccatctccatgggacttggaggttacttggctgccaagagtgaggctgaccactatatgagatgagcttaagatgggaggaagatagatgatcatttctctaccagatacagaagcagcggagattgcagataattttgtcacagtatgggattcagccccatgaatatggaccagttgtgaatgctttgaggaagaatccacaggcatggcttgactttatgatgaaatttgaacttggtttagaaaagccagatccaaggagagcgctgcagagtgcgtttaccattgccattgcttacatcttgggaggactagtccctctgatcccatacatgttcattccaatcgcaagaaaggctgtcgtcgcttctgttttggtaactttactggccttactaatcttcggctacgccaaaggccactttactggaaacaaaccgtttaggagcgccttccagacagcactaattggagcagttgcatctgctgctgcttttggcttggccaaggctgttcaaggcggcta

SEQ ID NO: 901 - DNA, 428 bp, Nicotiana tabacum
cggcagcaacagtgagaccgactgttagggcagcgacggcttgagtgtgttgtctgttggcgtcacagactccgaaaacgacgaggaccaaaatgaatccaagaatgaattcgattccgagcccttgaacttcagtcaagttagcattaagggaggtaactccgaatccgccagtgtaagaaggtggagtcaatgccttaaggagagcagatccagcaatagcgccaagaacttgaacgacgatgtagaggaaagctctgatcagtgtcacttttccggcagcgagaagtccaacagtgatggctgggttgatgtgagctccacttacgtgacccaacgtctgaacgagggcgaagacgatgaaaccgaaagtgagggcaatgaggactagatgggccggacaccccctccgcccatcactagtgaat

SEQ ID NO: 902 - DNA, 513 bp, Nicotiana tabacum
cgggcaaacgtggtgcgtggcgagtggtgaagcggggaaggataatctacaagcagctctagatttcgcttgtggtgagggcggagctgattgccgttcgattcagccagggtccacgtgttacaatcctaacacgctggaagctcatgcatcatatgctttcaatagttattatcagaagaaagggcgtgcgatgggttcgtgttatttcggtggggccgcgtacattgttcatcaacaacctaaatatggaaactgtgaattacccactgaagattgaaaaggagaggggatagactgaattttgatgaccatagttgtttaaggatagcagcagctcttattaatcttagctcctttcaattcagactattctttttttgtaatttttatctcattagttggtgttggtcgaggagagcaatgacttagttctagttgttgcttccctttttgtaattgtgttgacaacttgacatcaccttactactagtatatgttgcttgttttaaa

SEQ ID NO: 903 - DNA, 560 bp, Nicotiana tabacum
cggggcgtaagtcccgactgccgaggtgtaagtctcacggaactaagccccacacataagtcccggggcgttttacgagtgctccgctccagggcgagccccgggcgagtcccaattctgccttttaaaacagagctaattactatagtacaaagtaattttattctgtgcagtggagcatgaagtactcgaaagagaaagaggaagactacgagcattatatcagcaacagcaactgccacagtcacagcagcaacagcaatcatcttccagccatcggcgcagcactagtagggatcttgatcaacaatttgcaaacatctctttgaaacataaagacggttcaggccaacttcacatgtgactctgactgtagctaggacgtaaatcacatcttcctgactctccctcagctgatttttcctggcgagtgacaaaaactacactgggtttttattgtgcatggtcaagaagagctcttgtcgtccttgtgctctctctcagaagttctgcctccacgttctgccagtgattctaatttctatcatagtatgtatccc

SEQ ID NO: 904 - DNA, 339 bp, Nicotiana tabacum
cgggtcgatgatcatcaggttgtgcccgcaggccatttcccgatactgccagcccggactgcgtttggcccgcgcaccgtgcaacgggtaccccatgagatcggtgggcgggtcagtggccagcacataggtgcgccccatcgccacgttgcccagctggccgagccgcaaaggctcaagccagctgcgcagcgggtgcgatcgcagccggcgctgcaaccaggcaaccgcattttccccggtcacacccgtcgcctcgaccggataaggcggcaaccaaccgtcagcgtcggccatttcggcgatcgcctgacgtcgccccacagcggctgtgtcact

SEQ ID NO: 905 - DNA, 340 bp, Nicotiana tabacum
cgggtggcccattctttaaccctcttggatttggaaaagatgaaaaatctatgaaggatttgaagcttaaggaggttaagaatggaagattggctatgttggcaattttgggctatttattcaaggtttggttactggtgttggaccttaccaaaaccttcttgatcatttggctgatcccgtaaacaacaacatcttgaccaacttcaagttccactaagtgaacttgtagttatttcttcccaacttactcttctcttatgtgtaacactatgtgcagatactattttgtatgtcatctgtaatgctaaaaaggggacatttggtctaaaaagcctga

SEQ ID NO: 906 - DNA, 142 bp, Nicotiana tabacum
aggcagtaattgggactcgcccggggctcgccctggtagcggagcactcgtaaaacgccccgggacttatgtgtggggcttagttccgtgagacttacacctcggcagtcgggacttacgccccggacacccccgccgccca

SEQ ID NO: 907 - DNA, 261 bp, Nicotiana tabacum
gcaacaaatcaaatactcatgttcaacagagagttacaaactcataacatttaaccaaaccatgcgtttaagttcggaatgaaactgaaagtattgagataagataaaatgaaactttgcaattacttgactgcttctttcaaaattcaaacaaggatggacctctgaccggggccaggaccgttaaacgaaaactcatcggcgataacgacagtacctcgacttgtagctgaatggagtcccggacaccccctccgccca

SEQ ID NO: 908 - DNA, 659 bp, Nicotiana tabacum
cggctcgaatttaagaaacagtatgaggtctgtcaggatgccatggttcctgacctgttgatttttccaccaaggactgacctgcatgatcatcctttggtgaaaaatggaagtgtgtttttgcagggtaaggcgagttccatggttgcagttgctcttgggcctaaacccggatgggaggtcattgatgcatgtgcagcaccagggaacaaaactgttcatcttgctgctctaatgaagggaaaaggaaagattattgcttgtgaacttaatatagaaagggttaaacgtctgaaagacactgttaaactggctggaccaactagtatccttttagcagctttctaacgtgaaagtcaagcatgaggacttcttaaacttgagtcctgaggatccagcatactcaaaggttcaagcaatacttttagatccatcatgttctggatctgggacagttgttgatagattagatcatctgctcccctcatatactgcagattcctctgatgtacatagacaagaaagctcgctgctttccagaaaaggctttggaacatgcattatcttttccagctgttgagagagtgtttacagcacatgttctattaaccaagtgagaatgaagatgtaatcaactctgttctgcctctgcttcttct

SEQ ID NO: 909 - DNA, 285 bp, Nicotiana tabacum
cgggacagtcgggagcaatgtgtggctgaggtcaagctgagcgggagtgtagacaccggcaatcgggttgatgaacgcgaggtagcggcaggtttaccgacagcagaaggagtggtacaaggtctgagcaatgacgggaccttgcgaggcgtgaccagcagcactcgcgcgcgaacgccgacgccaagggtggtgcagagttggcgagtcggtcagggacaaagtcgaaacacgtctgataagaagtagaaattgtaggctgcaaaacgtttgtttccattcaaa

SEQ ID NO: 910 - DNA, 586 bp, Nicotiana tabacum
cggcttgctaatatcggagatcaagaagaaaacgcttgtcccacagcagtggtgcaaccccgcagtgatctcgacaaaggtatagcagtctacttcaaacctaaagagcccaaacatcagcagattgtggagtcttcttcgttaaacatcaatttctattttgatagtaataagtgtgctaacctaacagtgtggaaggtagacaactaccctatacctcgaaagtacagcacaataagcacaggtgcaaagttgggaaatcccctggatgtgaatagctggtttcaaattaagcctcttggtggctcgacgtataagctagtgttctgtccctacggagaggagtttacttgccaaaatgtaggcatcactgaggaaaatggatataggcgtttggttctcacagagaatgcaaaggcctttgtgttcataaagcatggcggattaggaaaggccgaagcatgattatgcatctgctttctaataaaactaagttgtgtaaaacatgtattaatgcaggccctgcatccgtgtctcactggatgtaagaataaataatgtaatgcagccctaataagtgcccaaa

SEQ ID NO: 911 - DNA, 202 bp, Nicotiana tabacum
cttcatgctccactgcacagaataaaattactttgtactatagtaattagctctgttttaaaaggcagaattgggactcgcccggggctcgccctggagcggagcactcgtaaaacgccccgggacttatgtgtggggcttagttccgtgagacttacacctcggcagtcgggacttacgccccggacacccccgccgccca

SEQ ID NO: 912 - DNA, 557 bp, Nicotiana tabacum
cggggaaaatattgtacacacaatgaagggaacatctggggataaatttgagttcaaggcccctcggagtgggatgtacaagttctgttttaagaatccttattcaacaccagaaactgtctctttctacatacatattggacacatccccaatgagcatgaccttgctaaagatgaacatttggaccccattaatgtcaaaattgctgaactaagagaggcattggagtcagttacttcagagcagaagtacctaagagcacgtgatgctcgtcatcgtcatactaatgagagcacaaggaagcgtgttatattttacacaattggagaatatctgctgcttatattggctagtgggcttcaggttgtgtatatccgacaactgtttagcaagtcagttggctataaccgggtttgacaaatttaggttgtagcatagtgttttttcacctctgttctacaggaacttgagttgttttggtcagttgagggaagggcatccctctgtagcatcttttcttaagttattatttgaaaggatttgatccattctcaaa

SEQ ID NO: 913 - DNA, 368 bp, Nicotiana tabacum
cggcacataccccaacgcgcgcttcttcaagctcgacgttgacgaggtccccgacgtcgcacaagaactcggcatccgcgccatgcccaccttcctcctcttcaagaacggcgagaaggtcgccgaggtcgttggcgccaaccccaaggctctcgaggccgccatcaagtccaacatcgatgcatagagtgcgcgcgcatcacgcacgttcaagcgatcacattcggcaacctagcattgggaaacgaggaagggatggacacaaaaggaggcatttttaggtgcacatgacgccctgccagacatggaagggatacactgtagcacagatatcatgataccctgctaaatgacacgattcacataaa

SEQ ID NO: 914 - DNA, 438 bp, Nicotiana tabacum
  modified_base (355)..(355): a, c, g or t
cgggacggtcaatggtgccgagcgacaacaagacgtgacgatgagcagagtcaatcccgtgcctaccacagggagccggttgatgcaggggacaatcgcttcaaggtcaagatgcggcacagtcgatgcctcctccatcaaccacgtcagtcccggctgcgtcgcatgggacagtcaggtttcctgggcagcagggtgggctggacgatgcgatgtggtctctcccacttcgatccgaggatgagcgatgatcaagccgcccagcttgccggtagtaccgacgatccactcgcaaaaagatagcattccctctcgctgttcctgatgctccaccaaggctcgggccagcttgtcnagcacgggatcagctgccgggtcggatgacgtcgaaacgctctgcccaccgcagagatctcgaagtgaaagacactgtcaaaa

SEQ ID NO: 915 - DNA, 255 bp, Nicotiana tabacum
cggggatgacttatgcattgcaagtggaacacctaacaatggcacatttgatccagggtttcaattacagaactccaactgatgagcccttggatatgaaagaaggtgcaggcataactatacgtaaggtaaatcctgtgaaagtgataattacgcctcgcttggcacctgagctttattaaaatctaagatgtatcatcttggttgatcattgtttaatactcctagatgggtatacatctaccttttttcaaa

SEQ ID NO: 916 - DNA, 459 bp, Nicotiana tabacum
cgggtacgtaacagtccacctgaatgggaagcctcgagtacttacattgaagcaggatttacattactggccaacatgggagctgaggtttgatccaggaactgctatgtggcgacgcaaaacaatcaaagctttggactctggtgttttgtgaacttacttggctgattaggttttcctgtggggatgtgcaaaattggggaacgtgtagaaagttcaccggctgcgttggtagttactctaacttattggagttgaaagtcgccatacatcaatatatgcaaaatcatataaagcaggtatctggctttatatactatttgttgtaaatgaccatttatcagatgaaattaataagtggtagaattttagacaagttataagtgctagcgctatacatgtctttgtgaatcagagtatgtaaaccatgaactaggaggggactttttgccaccaaaa

SEQ ID NO: 917 - DNA, 484 bp, Nicotiana tabacum
  modified_base (448)..(448): a, c, g or t
  modified_base (481)..(481): a, c, g or t
cggggtgatgggtctgggcaagaagatcatcaaccagaacagcggggctgcggaaaaagtcaagcagaccaagaccagcccggcggacgtcgtttcctggtccggctgcaaagatgatcagaccagcgctgacacacaaatcgcctcgcaagcgatcaggcgcaatgtcatacgctttcatctcggctctgaaccagatacccgcagcatagctaccagcagttgctggtcacgattccgggatgatgctaaaggggataatacagccagataacctcaactcagcgcgatgtcaccctatggacactcagctcttgtttatctgctagatacggctgtcgctcagatgtttaatcatcgaactcgaagataatttgtatcatacctatggaagtcggtcgcgcttgtaatggtcgtcaactttgttgttcttggctgctttcatganggctgtcgacgatacttgcatgaccgagggganaaa

SEQ ID NO: 918 - DNA, 219 bp, Nicotiana tabacum
cgggcaaacatggtgtgtggcgagtggtgaagcggggaaggataatctacaagcagctctagatttcgcttgtggtgagggtggagctgattgccgttcgattcagccagggtccacgtgttacaatcctaacacgctggaagctcatgcatcatacgctttcaacagctattatcagaagaaagggcgtgcgatgggttcgtgttattttggtgggga

SEQ ID NO: 919 - DNA, 510 bp, Nicotiana tabacum
  modified_base (124)..(124): a, c, g or t
  modified_base (283)..(283): a, c, g or t
ccgggacggtcaatggtgccgagcgacaacaagacgtgacgatgagcagagtcaatcccgtgcctaccacagggagccggttgatgcaggggacaatcgctatcaaggtcaagatgcggcacanacgatgcctcctccatcaaccacgtcagtcccggctgcgtcgcatgggacagtcaggtttcctgggcagcagggtgggctggacgagcgagtggtctctcccacttcgaccgaggatgagcgagatcaagccgcccagcttgccggtagtaccgacganccactcgcaaaaagaagcattccctctcgctgttcctgagctccaccaaggctcgggccagcttgtcgagcacgggatcagctgccgggtcggagacgtcgaaacgctctgccaccgcagagatctcgaagtcgaaagacactgtcaaaactcgtgtgaccagtaatcccgttagaggagcgacatatatggcatccgatatgaaacgctcgcaaaccactgtgaaa

SEQ ID NO: 920 - DNA, 332 bp, Nicotiana tabacum
actgatcaaagcactaaatacctcaaatgcttttgcaatctcatcaagtgttcaagaaattaatactaaaaaaataagccaaaaaggaaaagaacaaaatgttttacatatccactggcacacgtccatacaagtgtgcaggcaatcttggagtaggaatagcttgtattggatttttcatgtaagttactgttccagggctctcctccaagtcaatattctccgggttaacccccgggggcggagcccacgtaaaatgatgcaacaaatgacccaacatagatgtgaccaagttgatagcaagttgtgcacccggacacccccgccgccca

SEQ ID NO: 921 - DNA, 263 bp, Nicotiana tabacum
cacaagcaccactctttgatgcaagtaaaatccccccctttttttttttcttcaattaataaagtgggcacaacaaacgtggactaggcacagccacgagtcgattagctcttggagcagtgagtccaaaaatatcatccattttaagctcacttggtttcataccatctggcaattcccaagtaaagcaaagaagaagatgggccactgccatttctaatgcataaagcccaagttgcatacccgggcaccccctccgccca

SEQ ID NO: 922 - DNA, 556 bp, Nicotiana tabacum
cgggccgatgcgtccagcgccgacaagaagacgaccaaacacgaaaagagaagcttgggaggtttcggttcaggactaggactttccggtctcggctacagctccggtctcagccacggctccagtcttggctacagctcgggtctcagctacggctccggtcttggctacagctccggtttgggatacggttccggtctgagctccggctacggtccgggatacggttccggttcgagctatggttccggcctgagctccggctacggtctgggatacggttccggttcgagctacggctccggcctgagctccggctacggtcttggctacggttccggttcgagcttcggttctggtctaggatactccgctgccgctgctgctcccgcaccgacaaccggccccatcgctccaatctccaaggaagtgcacatcatcaaccgacatgcccaacctgtgtccgccccgtacccagtgccagtaactcacgacgtgccgttcccgtgccacatgcagtgcctacccagtcgacaaaccataccagtcaatgtac

SEQ ID NO: 923 - DNA, 234 bp, Nicotiana tabacum
ctattagtagcatccaagtatgtgacctaaaggtcgatgaagtaggtgcaaaccatgaagaattgaaaatcatagtagaaaccccatcagagacaaagcactaggcttcacatctgcctaagtctcggtgggcaaagttacacaacacctgttctagtcgaggtagcaaggtagcagatacccggtgggaatagccgaggtgcgcacaagctgcccgggcacccccgcctccca

SEQ ID NO: 924 - DNA, 207 bp, Nicotiana tabacum
cgggactccattcagctacaagtcgaggtactgtcgttatcgccgatgagttttcgtttaacggtcctggccccggtcagaggtccatccttgtttgaattttgaaagaagcagtcaagtaattgcaaagtttcattttatcttatctcaatactttcagtttcattccgaacttaaacgcatggtttggttaaatgttatgagtta

SEQ ID NO: 925 - DNA, 551 bp, Nicotiana tabacum
catcactcgtaagttctctttgttcatagtaatgtatctgatatcaattgaaaagttgtgacttaaaaatatagcagtggtggtgttttgatactctttggttgtgctgtgatcacttccctgcttcagtcggtgttttggtagtcatctggtcaactgcatgcacagtgttctgaagttcttcccatatggctttgtagaccatcctctgcctattcacagcagattgtccctcaaaagctgaagagactacatcaatgctgacatgccgaccatcaccataagcatctttaactacaactatgtccgcattcaactgctccttgatctttttctgcatagactccataagaggagaatcaattgagccagtatcgctagtcgcacgagtagagaaagtccgacgaccagcgaaaagctcaatctttgaacctatttggggaacgagcttcattggcctgtaggaacgagcagaaatagaaacgcatttgagtaatgaaggtacacgtggctgacggagctgctcaatcgccggacacccccgccgccca

SEQ ID NO: 926 - DNA, 256 bp, Nicotiana tabacum
cggccaattggagtagcgttgcacacagccatagcagagatgtatctgaatgattaccaacgttccattgcgatttagatatatttacactgtcgttagttggtctctcgagtcgtataaatgttccaatcactactcatacattctgcgcattgtatatattgcaacgataaacaagcaaggtcatgtggttccttttctttttcttgtttgccatggtgactcttgcgctctttaaagtttctcttatgcaaaa

SEQ ID NO: 927 - DNA, 448 bp, Nicotiana tabacum
cggcccgagaacgaacgatttcatattttttggtttttttgcttactgttcgaaacgcgcaaatttatatcaatattcatgatattaatttatcggtggtccagaggaaatcgttaagagtgacgcactgccagtttgtggattttcaccgagtcaaaaccgtctgaagaggactcctcgcgtacataacaatactataggtgaagtcttttcgactcgtttcgtattcatcgcgtcatgatgccggtaaggctgcagtgggtccgacttttaagccgctgtcacttgcggcggacgtgcgtcccgttgacctacatcgctccgagtcaaccggtccgacatcgcaccgagtctaaggtggtccgttcgccgttttcggacgttcagatccccgaatgtttgatcgacgaattgtgtggagcgacctggagaggtggccggacacccc

SEQ ID NO: 928 - DNA, 439 bp, Nicotiana tabacum
ttttacaacttaatcgcacttgagcaacaacaagaaagcttgctggtacttttacttgtataacatatccattatagaaatagttttagatccaaggctatccactgtgaatgaggggattgaattactccacatggaacgatagaaagattcacacggattgagaagcaagagaacaaaaacaaaagtataacggaaactgtaagaagtcaaagtgcactctgtttcatccatgtcattcatcaaactcatgcatatgatccaagagatagtttgcagccagctcctcatttttgttgcatgcaaaaaatacttgcaaaaccaaagctcgatcgaaacccatagcttcaagtcgttcgatagcctcgcgctcttccggtgtgacagtcacagcttgtggtatcgcccctgctggctgcccgggcacccccgccgccca

SEQ ID NO: 929 - DNA, 297 bp, Nicotiana tabacum
cggcgaatggaattgaagtacaactagagatgtggaatgacaaccaaacaagaccgcagtttgacaaagctaatattggtgggtggaaagtactagggtcttcagctacggacaaagatggtcgaagtggtcagttgatgaatatggttgaagctttggctccaggaatatatcggataagtttcaacacgggtgagtatattcctgatggattttttccctatgtctctattgtttttgagatcagagagtcccagaaatgggatcactttcatgttcctttgctgctctctccaa

SEQ ID NO: 930 - DNA, 552 bp, Nicotiana tabacum
  modified_base (104)..(104): a, c, g or t
cggggatgatcgccgaaaagtgcaagatgggaatcatgcccgggcacatctttaccgagggaaagatcggaatcgtctctagatccggaaccctgacttacganggccgtcaaccaaaccaccctcgccggtctcggacagaccttgaccgtcggtatcggtggtgaccccttccccggtacccaacacatcgacgtcgtcaaggtcctccttgaagaccccaagactcagggtatcgtcctgatcggagaaatcggtggaaccatggaggaagaggccgctgcctacctcgagcagttcaacaagacccgatcgaaccccaagcccgtcgtctcgttcattgctggtgccaccgctcctcctggcaggaggatgggtcacgccggtgccatcatctcgggaggcaagggaaccgcttcggccaaggtcgaggccctggaaaaggccggcgccaagatcgccacctctcccgctcagatcggtgacttgatgttgaaggcgatgaagagctggtctcgcatagatgcaggaatgagtaacggcagaggcgta

SEQ ID NO: 931 - DNA, 336 bp, Nicotiana tabacum
tgcgcatcacttggcatttttgcggacaaacaccaagaatcagttatattaggttgaaggaactaaaagtttaaagcaacaaatcaaatactcatgttcaacagagagttacaaactcataacatttaactaaaccatgcgtttaagttcggaatgaaactgaaagtattgagataagataaaatgaaactttgcaattacttgactgcttctttcaaaattcaaacaaggatggacctctgaccggggccaggaccgttaaacgaaaactcatcggcgataacgacagtacctcgacttgtagctgaatggagtcccggacaccccctccgccca

SEQ ID NO: 932 - DNA, 339 bp, Nicotiana tabacum
  modified_base (165)..(165): a, c, g or t
  modified_base (298)..(298): a, c, g or t
cggagggggtgcccggcggaaccttggatcgtgagactctgaaggcgtttttcgctgtcagtggcgaacctggtagctttacgcacagccccggccaagaacgtattcctctaaattggtaccgtcgccctacgacttctcaatacaacgtcgtcgaggtagtcncacgacctccacgatcagcaacgctgcctacccgggtatccttcgcgtcggagggaacacaggaaccaccgacagcttcaccggcgtcgatctgcaggatttggacgggtggcgtgttcaactcagcgacgcncttcgatggcaacaatgcagcgtgcttcttgtaccaggcaa

SEQ ID NO: 933 - DNA, 184 bp, Nicotiana tabacum
cgggtgtggaccgctgacattatacccgaggagctcatgccatttactgaggaatgaagctatactcgtaagtggtgcatctcgtgctttatcagttctgtcaatggcgaaagccggtctcgtaattgtgccttcttctcttcctctacagcggtttcatggtgccggacaccccctcctccca

SEQ ID NO: 934 - DNA, 180 bp, Nicotiana tabacum
gtctcaactcaagttcctgctgcaataaacatatgaggtaaattcaacaaacaggaaaggcctgttcatgctactctgaacacagacccagcatatacttggaatctataaatacaagttaggtagctgacgcgcactatactcgcactccaaagcattcccggacaccccctccgccca

SEQ ID NO: 935 - DNA, 521 bp, Nicotiana tabacum
  modified_base (415)..(415): a, c, g or t
accccattcgtacgtaatggaacagcctcatctatattgtaaccacttgtccaagtaacagtcattatatcccatgatttcccaagagtaagacgcggataaaggggtgctttcggattggcaaatgcaatgtaatttgagatggctatcaacttgggatttgacaaacccccagatgaataaggcaaatgatgaaatccccacgctggttaattatccggaaattcagtgaagttttccctgtctttgtgtacttgtcattgctgtaatttgcaaatttgaactttaagggggcagtacagataaatggatgctccagattgttgttctttgatggtttgtgggggacaaatggattcactttgatgataactgggcttttgatttccttgaaggaccaccaccattaaacgancatcactggacggccagcatcaacaaaataaccaatcgcggagttcactccaaatagtatcacccaattccattaacgccgccgacccgggcacccccgccgccca

SEQ ID NO: 936 - DNA, 227 bp, Nicotiana tabacum
cgggactccattcagctacaagtcgaggtactgtcgttatcgccgatgagttttcgtttaacggtcctggccccggtcagaggtccatccttgtttgaattttgaaagatagcagtcaagtaattgcaaagtttcattttatcttatctcaatactttcagtttcattccgaacttaaacgcatggtttggttaaatgttatgatgtttgtaactctctgttgaaaa

SEQ ID NO: 937 - DNA, 284 bp, Nicotiana tabacum
cggggacgggcgagtataaatgatagcaagggcaaaagcagacactggcttgcggaaaccttgctgtgcttgctgcaattgtcctgtagaatttgtggaccagagctttatggatggacagcactacaagctctttagtattgaaaccagagtagcgcagctggacgtgacaatggcccactatcgacatcacgcactggatctccgactgttcaccggccttaaatcaaatgtgatgtcttactggacaactgaaaatacatgctcctaacgcttctgcaaaa

SEQ ID NO: 938 - DNA, 215 bp, Nicotiana tabacum
gtctgggaatgctttggagtgcgagtatagtgcgcgtcagctacctaacttgtatttatagattccaagtatatgctgggtctgtgttcagagtagcatgaacaggcctttcctgtttgttgaatttacctcatatgtttattgcagcaggaacttgagttgagacattagagattgctggtatatatttttaagagcttgctcgttttgcaaaa

SEQ ID NO: 939 - DNA, 487 bp, Nicotiana tabacum
gctgagaggggaagtggtggtggcactgagatgagaagaaggaacgaagagaactctgttagggtcaccaacctttctgaggacactcgggaggctgacttgttggagctgttccgtccctttggtcacgtcagccgagtgtatgtcgccattgatcaaaagactggaatgagcagaggatttggttttgtcaactttgtcaacagagaagatgctgagagggccataaacaagctgaatggttatggttatgacaatctcatccttagagttgaatgggctgctcctagaactaattagctttctttcctaggccaatactgtgttgttcccaaaaactgttgttgggaaccataattttgcttcctgtatgttgtgtttaagaatgtcactcctgcctcatttattggaggaacaaaagagaacgttgtttccttgattatttgttcttcaaaactgtggtatggtcattctgtctagtgcataa

SEQ ID NO: 940 - DNA, 454 bp, Nicotiana tabacum
gcggtcgtggtcgctctggaggctctgatttgaagtgctacgagtgtggcgagcccggtcattttgctcgtgagtgcagattgagtggagctcctggaagacgtagaagtcggagccctcctagatatcgaaggagcccaagttatggtcgtaggagttatagtcctcatgggcgttccccccagcgccgaagcttgtcaccgcgcggtcgcagctatagccgatctccatatcgcggccaagataaagttccatatgctaatggaaatgggctcagagagcgccgcagaagccgaagctgaatgggagagatgattgcctgtcttgtccaggagttttcgattagtgtgttactgtccttgacttaatcacagctgtgtaagtggggccacaccctctgcttaaactggtagcttttgctaaatttcagttattgctttgacatgatacgtga

SEQ ID NO: 941 - DNA, 254 bp, Nicotiana tabacum
gtctgggaatgctttggagtgcgagtatagtgcgcgtcagctacctaacttgtatttatagattccaagtatatgctgggtctgtgttcagagtagcatgaacaggcctttcctgtttgttgaatttacctcatatgtttattgcagcaggaacttgagttgagacattagagattgctggtatatatttttaagagcttgcttgttttgtacatgtttcttttagagtaggaccttaccgttgatttccctta

SEQ ID NO: 942 - DNA, 237 bp, Nicotiana tabacum
tttggggggggggggcgggggtgtctgggaatgctttggagtgcgagtatagtgcgcgtcagctacctaacttgtatttatagattccaagtatatgctgggtctgtgttcagagtagcatgaacaggcctttcctgtttgttgaatttacctcatatgtttattgcagcaggaacttgagttgagacattagagattgctggtatatatttttaagagcttgctcgttttgctaaa

SEQ ID NO: 943 - DNA, 457 bp, Nicotiana tabacum
  modified_base (427)..(427): a, c, g or t
gctgcgcaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgatgactcttgtggcaaatgcttaagggtgacaaatacaggcacaggatgctcagaccacagtgagaatcgtggatcaatgcagcaatggcggactagacttggacgttaacgttttccggcagctcgacacagacggaagatgggaatcaacgtggccaccttattgtgaactacgagtttgttaattgtggtgacaatatgaatgttctggtatccccagttgacaaggaataagaagctatatatggccatgttnagtcttggaccggcccaaataaaagtaaaa

SEQ ID NO: 944 - DNA, 262 bp, Nicotiana tabacum
gtcaacggcggtggttgcggcggcggttgtggtggatgtggaggttagtgttgatttggacactagccacccatctagttagcatggcttttaattttcctcttcttgttgttttctttcctttttcgtttcttcttatcctttttgttgttttaaatttttttatttgtatgttgtttcgaattgggaatggacttccaaaaggtgtgtaaatgaaattatgaatgattgcatgtatgatagaatgagtccatagcgaaaa

SEQ ID NO: 945 - DNA, 513 bp, Nicotiana tabacum
gctgcgcaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgagactcttgtggcaaatgcttaagggtgacaaatacaggcacaggatgctcagaccacagtgagaatcgtggatcaatgcagcaatggcggactagacttggacgttaacgttttccggcagctcgacacagacggaagatgggaatcaacgtggccaccttattgtgaactacgatgtttgttaattgtggtgacaatatgaatgttctggtatccccagttgacaaggaataagaagctatatatggccatgtttagtctttgacggcccaaataaaagtaaaaagaacgatatgtaaaaggaaaaagaaaataaagttgctttgatggggttaggcaatt

SEQ ID NO: 946 - DNA, 325 bp, Nicotiana tabacum
  modified_base (209)..(209): a, c, g or t
gctgcagttgctgttgctgctcccgctggtggtggtgctggtgctgcagcagctgcccctgctgcagaggaaaagaaggaagatgcccaaggaagaaagtgatgacgacatggggttcagtctgtttgactaggagctcctttcagtatgatatttggttccttttagatgaattgatgaaacttggtaatagcaccctttataaggangatttttgatctgtttgtcacaattaaatgtaatcttgaggttatgatttatgaacatctgtcatgtcagtaattgctacttattgtcgactccaaaaaaaaaaaaaaaaaaaaaa

SEQ ID NO: 947 - DNA, 216 bp, Nicotiana tabacum
gtctgggaatgctttggagtgcgagtatagtgcgcgtcagctacctaacttgtatttatagattccaagtatatgctgggtctgtgttcagagtagcatgaacaggcctttcctgtttgttgaatttacctcatatgtttattgcagcaggaacttgagttgagacattagagattgctggtatatatttttaagatgcttgctcgttttgcaaaa

SEQ ID NO: 948 - DNA, 250 bp, Nicotiana tabacum
gctgcagttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagatgaattgatgaaacttggtaatagcaccctttataaggagatttttgatctgtttgtcacaattaaatgtaatcttgagga

SEQ ID NO: 949 - DNA, 198 bp, Nicotiana tabacum
gtggcggacgcggtggaggatactgccgctatggttgttgcggccgccggaattattatggttgcagcaggtgctgctcctacaaaggtgaggccatccatggataaggtcactgaagctttgtactcgcaagatgtaatagtaataatcttgcagctttagagcttgttgtaacaagttatgaataaaattaagtca

SEQ ID NO: 950 - DNA, 509 bp, Nicotiana tabacum
gcgcaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcatggccgagactcttgtggcaaatgcttaagggtgacaaatacaggcacaggagctcagaccacagtgagaatcgtggatcaatgcagcaatggcggactagacttggacgttaatgttttccggcagctcgacacagacggaagagggaatcaacgcggccatcttattgtgaactacgagtttgttaattgtggtgacaatatgaatgttctgctatccccagttgacaaagaataagaagccatcgatgcccatgttttagtcttttgacggcccaaataaaagtaaaaagaacgatatgtaaaaggaaaaagaaaataaaagttgctttgaaggggttaggcaat

SEQ ID NO: 951 - DNA, 302 bp, Nicotiana tabacum
gctgcagttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttggtaatagcaccctttataaggagattttcgatctgtttgtcacaattaaatgtaatcttgaggttatgattatgaacatctgtatgtcagtaattgctacttatggtcactccaaaa

SEQ ID NO: 952 - DNA, 309 bp, Nicotiana tabacum
  modified_base (210)..(210): a, c, g or t
  modified_base (250)..(250): a, c, g or t
gctgcagttgctgttgctgctcccgctggtggtggtgctggtgctgcagcagctgcccctgctgcagaggaaaagaaggaagagcccaaggaagaaagtgatgacgacatggggttcagtctgtttgactaggatgctcctttcagtatgatatttggttcctttttagatgaattgatgaaacttggtaatagcaccctttataaggangatttttgatctgtttgtcacaattaaatgtaatcttganggttatgatttatgaacatctgtcatgtcagtaattgctatcttattgtcgactcaaaa

SEQ ID NO: 953 - DNA, 318 bp, Nicotiana tabacum
  modified_base (86)..(86): a, c, g or t
  modified_base (100)..(100): a, c, g or t
  modified_base (117)..(117): a, c, g or t
gctgcagttgctgttgctgctcccactggtggtgccggtgccggtgctgcagctgctgcccctgctgcggaggataaagatagganagatgcccaagganagataagtgatgacgancatgggattcagtctgtttgattaggatgctcctttcagtatgatatttggttcttttttagatgaattgatgaaacttggtaatagcacccttgttaaggatgatttttgatctgtttgtcacagttaaatgtaatcttgaggttacgatttatgaacatctgttatgtcagtaattgttacttattgctgtctccaaaa

SEQ ID NO: 954 - DNA, 236 bp, Nicotiana tabacum
gctggttatgattctggccctggcgctggttatggtggaccaggaggtttatacggaagtagggcaggctatagtggcagcggccgttaccatccctatgccaggtagattatcttaagcatttcctaggagttgcattcaggctcttggtaatgatctttggctcagagttgagtagatatgggatcgctagcaagcagacaacatctagaagattggcagaaccctagtttgta

SEQ ID NO: 955 - DNA, 285 bp, Nicotiana tabacum
gtggggctaaaatcctttatggcaagggtgcatttgatcgccacttttcacagaatagaccaaaggattctgagacaaacctggaggggtctgacggagaccacgagacggaacaagagcttccttccattgttgctttgtaaatgttctgtgaggtgtatttctggtctcaactatgtacagtaatctaaattcaaataaacagtgttaatttaataagctcaatgtgctttcatactgcatttttgttgtgttttactgttatcttgctatttattcttaaaa

SEQ ID NO: 956 - DNA, 308 bp, Nicotiana tabacum
agcaattactgacatgacagtatgttcataaatcataacctcaagattacatttaattgtgacaaacagatcaaaagtctccttataaagggtgctattaccaagtttcatcaattctctaaaaaggaaccaaatatcatactgaaaggagctcctagtcaaacagactgaaccccatgtcgtcatcactttcttccttgggctcttccttcttttcctctgcagcaggggcagctgctgcagcaccagcaccaccaccagcgggagcagcaacagcaactgcagcacccccgcccccccccccgaaa

SEQ ID NO: 957 - DNA, 238 bp, Nicotiana tabacum
gtggaggaccagtggtggtggacgtggaggtggcggaccggtggaggatactgccgctatggttgctgcggccgccggaatatatggttgctgcggccgccggaatatatggttgcagcaggtgctgctcctacaaaggtgaggccatccatggataaggtcactgaagcttgtactgtaagatgtaatagtataatattctgcagttttagagcttgtgtaacaagtatgaataaaa

SEQ ID NO: 958 - DNA, 258 bp, Nicotiana tabacum
ttttttttttttttttttttttttacaaaacgagcaagctcttaaaaatatataccagcaatctctaatgtctcaactcaagttcctgctgcaataaacatatgaggtaaattcaacaaacaggaaaggcctgttcatgctactctgaacacagacccagcatatacttggaatctataaatacaagttaggtatgctgacgcgcactatactcgcactccaaagcattcccagacacccccgcccccccccccgaaa

SEQ ID NO: 959 - DNA, 397 bp, Nicotiana tabacum
gccgttgtggcgatgcggtagagtatggcaggagttgggacggagaataatagaggaagatgaataggtggttgcacagtggtaagcaacgactatggtggaaatagaaaggaggaaggaggagataggagaaataattggaaaaacagaagataatgcctctcacgcgcctcaacagtggggtgttacatacattatgctatgtcagcaatttgtgtctaattgacacaatttgcattcacttcaagtgttcaataggcactattattagttgaagtgtttgagtgaaaaatattgcccaagtttatggggccgcctatgtattctgtctttaattaaagtactgaaatatattgtaaattattagaggaaattagtaaaagattgaaatttcata

SEQ ID NO: 960 - DNA, 249 bp, Nicotiana tabacum
gctgcagttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttgtaatagcaccctttataaggagatttttgatctgtttgtcacaattaaatgtaatcttgaggta

SEQ ID NO: 961 - DNA, 632 bp, Nicotiana tabacum
taggagtactcaatgaagaattatacatagatctccataacacaaggggacatgtctacatcacaaatgtgacgctacagccgaatggagaaacagcactacaatgttctaaaggatgataagtagccaattatatcagattattacagacacggcttgccagtttatttgacagagaagcctagaccacaaccctaaggtacataagtgatttagcgatactgaggagccagttccccatccttgacaatgtaattttgtgctgggaaatcctcgcccttgaagtacctgtccagcatatccttcgttccagcagcataccgcaactgtgcatcaatggtagtccctgaaatgtggggggtcatagcttggtttggcatgtagcgccacggatggtccttgggagctggttgtgggtaccaaacatctccactgtatcctgcaatatgaccactattacaagcatcaacaactgcttgagtgtccatgattgctcctcgagcattgtttacaattagaacgcccttcttcatttttgcaattctttccttgtcaaacatcccttttgttttctctgtaagaggtgtattgacgaccactatgtcacattttgaaagcatcttatcaagatc

SEQ ID NO: 962 - DNA, 222 bp, Nicotiana tabacum
aaagggtgctattaccaagtttcatcaattctctaaaaaggaaccaaatatcatactgaaaggagctcctagtcaaacagactgaaccccatgtcgtcatcactttcttccttgggctcttccttcttttcctctgcagcaggggcagctgctgcagcaccagcaccaccaccagcgggagcagcaacagcaactgcagcacccccgcccccccccccgaaa

SEQ ID NO: 963 - DNA, 236 bp, Nicotiana tabacum
gtcaacggcggtggttgcggcggcggttgtggtggatgtggaggttagtgttgatttggacactagccacccatctagttagcatggcttttaattttcctcttcttgttgttttctttcctttttcgtttcttcttatcctttttgttgttttaaatttttttatttgtatgttgtttcgaattgggaatggacttccaaaaggtgtgtaaatgaaattatgaatgattgcatga

SEQ ID NO: 964 - DNA, 305 bp, Nicotiana tabacum
gctgcagttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttggtaatagcaccctttataaggagatttttgatctgtttgtcacaattaaatgtaatcttgaggttatgatttatgaacatctgtcatgtcagtaattgctacttattgtcgactccaaaa

SEQ ID NO: 965 - DNA, 240 bp, Nicotiana tabacum
gtcaacggcggtggttgcggcggcggttgtggtggatgtggaggttagtgttgatttggacactagccacccatctagttagcatggcttttaattttcctcttcttgttgttttctttcctttttcgtttcttcttatcctttttgttgttttaaatttttttatttgtatgttgtttcgaattgggaatggacttccaaaaggtgtgtaaatgaaattatgaatgattgcatgtatga

SEQ ID NO: 966 - DNA, 574 bp, Nicotiana tabacum
gttagagccaatgcacaacagccaaagctttttgtcgggatgattttgattcttatttttgctgaagccctggctttgtatggccttattgttggaatcatcctctcttctcgtgctggtcagtctagatgcagagtagaagaagagaatgttgtgcaccattactgtgaattatctttgtttttttcatggataagctagtctggctgttgaattaaatttccttttatctctgggttgcaagattctgtacttgattgcttggttagaagaattggttcatatgtgcggttctgctatagattagatctctaaataaagaagtcggttaatctgatgccccaactttcaaggattcgggggggggggcgggggtgtctgggaatgctttggagtgcgagtatagtgcgcgtcagctacctaacttgtatttatagattccaagtatatgctgggtctgtgttcagagtagcatgaacaggcctttcctgtttgttgaatttacctcatatgtttattgcagcaggaacttgagttgagacattagagattgctggtatatatttttaagagc

SEQ ID NO: 967 - DNA, 176 bp, Nicotiana tabacum
gcaccccgtagctcaagcttctcttagattgatcttatctttattgtagctagttttatgcaattttgataatcacatgctggaattgacttgcagcagtcgaaagcacttggttcaattgggcataaacttctttattggatttttagagaactaattttgcatgtatagtaata

SEQ ID NO: 968 - DNA, 471 bp, Nicotiana tabacum
  modified_base (218)..(218): a, c, g or t
cagcaaatatatatggaaaggtagcctgagcagaaggaggaactgttgcgttgttaaaagcctgaacagaaagattttgaaccaaatagcgatgatcaaagggaaggtgaacactggcttggatggcaatgatattcagatttgatcccccatcatttttcattccaaccaacagctctctctcctcaccagctgccactactttagaagggttttangggaaaacacaaatcgtttcaatcccaggtgcaggactataactctcactgctaaaatcttggacatcctcaccaacaattccaagatcccctccttcctcggtaccctcaaccacttctgcttcagggtcggattgagctctagcaacttgaagaaatgatgaagagaagaggagaagagccaggacgatagaaaaccctaattgtcattttgagaggaaggcggagcacacccccgcccccccccccgaaa

SEQ ID NO: 969 - DNA, 434 bp, Nicotiana tabacum
tttaaagaataatattcgggttcaaattacccgcttttaggcctaatttcggacttagcccataataattcgagtccaccacacatgaggggacacgcgtggggaacacggacggaatcctgtacacggggaaccccaccacgcgtgggggacacaagtctcgaaccccaccacgtgtggggctcatttccctgggcaaaaccattacaaaggcacggtcaaaaacattttaaaagggggattttggaaaagtttttgctgggaactactgttcatctttcttctttaagaaagaaagaaaaacctactggaaaaaaaaaacgaacaaaccacccaagcaccaactccaccacccgtcaccttccccggcacccctacagtcgcaacccccccagtgccggaactccagctccctccgtcgttcaccatcctcg

SEQ ID NO: 970 - DNA, 231 bp, Nicotiana tabacum
gtggcggacgcggtggtggtggacgtggaggtggcggacgcggtggaggatactgccgctatggttgttgcggccgccggaattattatggttgcagcaggtgctgctcctacaaaggtgaggccatccatggataaggtcactgaagctttgtactcgcaagatgtaatagtaataatcttgcagctttagagcttgttgtaacaagttatgaataaaattaagtcatca

SEQ ID NO: 971 - DNA, 306 bp, Nicotiana tabacum
gctgcagttgctgttgctgctcccgctggtggtggtgctggtgctgcagcagctgcccctgctgcagaggaaaagaaggaagatgcccaaggaagaaagtgatgacgacatggggttcagtctgtttgactaggagctcctttcagtatgatatttggttcctttttagatgaattgatgaaacttggtaatagcaccctttataaggagatttttgatctgtttgtcacaattaaatgtaatcttgaggttatgatttatgaacatctgtcatgtcagtaattgctacttattgtcgactcaaaa

SEQ ID NO: 972 - DNA, 248 bp, Nicotiana tabacum
gtggcggacgcggtggaggatactgccgctatggttgttgcggccgccggaattattatggttgcagcaggtgctgctcctacaaaggtgaggccatccatggataaggtcactgaagctttgtactcgcaagatgtaatagtaataatcttgcagctttagagcttgttgtaacaagttatgaataaaattaagtcatcatttaatgtttgtgttagttatacaatggtgtgataatgttttcccta

SEQ ID NO: 973 - DNA, 242 bp, Nicotiana tabacum
gcggaggatactgccgctatggttgctgcggccgccggaattacaggtgctgctcctacaaaggtgaggccatccatggataaggtcactatattgaagctaagcctcacaacgtatcatcatgtggagcaatatataaaacctttgtactttgtaaagcctcaagatgtaatagtaatgatcttgcagctttttagagcttgttgtaacaagttatgaataaagttaagtcaacaacaaaa

SEQ ID NO: 974 - DNA, 462 bp, Nicotiana tabacum
gctgcgcaaaacgttagggcaacttatcatatatataacccgcagaatgttgggtgggatttgtatgcagttagtgcgtactgctcaacttggatggtaacaagcctttggcatggaggaggaagtatggttggactgcattttgtggccctgttggacctcgtggccgagactcttgtggcaaatgcttaagggtgacaaatacaggcacaggatgctcagaccacagtgagaatcgtggatcaatgcagcaatggcggactaggcttggacgttaacgttttccggcagctcgacacagacggaagatgggaatcaacgtggccaccttattgtgaactacgatgtttgttaattgtggtgacaatatgaatgttctggtatccccagttgacaaggaataagaagctatatatggccatgtttagtctttgacggcccaaataaaagtaaaaagaacga

SEQ ID NO: 975 - DNA, 216 bp, Nicotiana tabacum
gtctgggaatgctttggagtgcgtagtatagtgcgcgtcagctacctaacttgtatttatagattccaagtatatgctgggtctgtgttcagagtagcatgaacaggcctttcctgtttgttgaatttacctcatatgtttattgcagcaggaacttgagttgagacattagagattgctggtatatatttttaagagcctgctcgttttgtaaaa

SEQ ID NO: 976 - DNA, 263 bp, Nicotiana tabacum
gtctgggaatgctttggagtgcgtagtatagtgcgcgtcagctacctaacttgtatttatagaattccaagtatatgctgggtctgtgttcagagtagcatgaacaggcctttcctgtttgttgaatttacctcatatgtttattgcagcaggaacttgagttgagacattagatgattgctggtatatatttttaagatgcttgctcgttttgtacatgtttcttttagatgtaggaccttaccgttgatttcccttcaaaa

SEQ ID NO: 977 - DNA, 208 bp, Nicotiana tabacum
gctcgtgctaggttccagaaatcttaccgttaaaattcctatttcgatttatggtatctgtttttatccctgttggtatggttttggtttaggaatcattatggatttactgctatctgagaaagttttggatttggataaactttaatatagctgtttcacatgctatgaaatatgaatgcaatgaattgtgcttttatttgcaaaa

SEQ ID NO: 978 - DNA, 310 bp, Nicotiana tabacum
  modified_base (213)..(213): a, c, g or t
gctgcagttgctgttgctgctcccgctggtggtggtgctggtgctgcagcagctgcccctgctgcagaggataaagaaggaagatgcccaaggaagaaagtgatgacgatcatggggttcagtctgtttgactaggatgctcctttcagtatgatatcccggttccttttagatgaattgatgaaacttggtaatagcaccctttataaggangatttttgattctgtttgtcacaataaatgtaatcttgaggttatgattatgaacatctgtcatgtcagtattttgctacttatgtcgactccaaaa

SEQ ID NO: 979 - DNA, 347 bp, Nicotiana tabacum
  modified_base (294)..(294): a, c, g or t
gctgcagttgctgttgctgctcccgctggtggtggtgctggtgctgcagcagctgcccctgctgcagatggataaagataggaagatgcccaaggaagataagtgatgacgatcatggggttcagtctgtttgactatggatgctcctttcagtatgattatttggttcctttttatgatgaattgattgataacttggtaatagcaccctttataaggatgatttttgattctgtttgtcacaattaaatgtaatcttgatggttatgatttatgaacatctgtcatgtcatntaattgctacttattgtcgactccaatcatgtccctttattgctgtgacaaaa

SEQ ID NO: 980 - DNA, 217 bp, Nicotiana tabacum
gtctgggaatgctttggagtgcgagtatagtgcgcgtcagctacctaacttgtatttatagattccaagtatatgctgggtctgtgttcagagtagcatgaacaggcctttcctgtttgttgaatttacctcatatgtttattgcagcaggaacttgagttgagacattagatgattgctggtatatatttttaagatgcttgctcgttttgtaaaa

SEQ ID NO: 981 - DNA, 579 bp, Nicotiana tabacum
  modified_base (305)..(305): a, c, g or t
  modified_base (483)..(483): a, c, g or t
caggtgtgcaatttattcggaaaaatgctcaaatctcaaagcagcgagtcacgaaaaaaaaagttacagaagctctacaacctctctaaacaacaaatgaacagagatattgcaccatcccatccccttatatggatgcaaagtattctttgctgcccttaggatctggcttcattgacttgtcaccaggcttccacccagctgggcatacttcatctgggttctcctgaacatattgcaatgcctgaagtgtcctcaatgtttcatcaacacttcggccaattgcaagattattaatggtggangtgttggataactccttccttgtcaatgataaaaagtcctctcagtgcaattccctgatccggtatcagtacattgtaagattttgaaattgactttgtcacatccgaaattaatggatagttcagatcaccaaggccaccagacttcctatcagtttggacccaggcaaggtggganaaacacactgtctacggagacacccaatatttctgtgttcaccttctgaaattcttcataacgatcactgaaagcagtgatctctgtcgggcaaac

SEQ ID NO: 982 - DNA, 605 bp, Nicotiana tabacum
  modified_base (72)..(72): a, c, g or t
  modified_base (82)..(82): a, c, g or t
  modified_base (104)..(104): a, c, g or t
  modified_base (161)..(161): a, c, g or t
  modified_base (193)..(193): a, c, g or t
cggccgccatggcggctgcggcgtagcggtatgcagctcactcaaaggcggtaatgacggttatgccacagnaatgcagtgngatgaacgcaggaaagaacatngtgagcaaaaggccagcaaaaggccaggaaccgtaaaaaggccgcgttgctggcgtnttttccataggctccgcccccctgacgagcantcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaga

SEQ ID NO: 983 - DNA, 485 bp, Nicotiana tabacum
aaagagacgctgcggttgcgtgactctaaggggaagccaccaggagttctaggatggtggccttcaagggctgtgacttttattgataatcacgacactggatccactcaggcacactggcctttcccttcaaatcacattatggagggctatgcgtacattctaacacatccagggataccatcagttttctatgaccatttctacgattggggtaattccacgcatgaccaaatatttaagctgattgatatccgaaggcatcaaggcatacacagccgttcatctgtacagattcttgagtcacaaccaaacttatacgctgcaaccattggagaaaaggttagcatgaagatcggggacggatcatggtgtcctgcaggcaaggagtggaagcttgcaaccagtggctatcgctatgcagtctggcagaagtaataagtagagcatagagctattctctttctcaaaaatatagactaaaa

SEQ ID NO: 984 - DNA, 480 bp, Nicotiana tabacum
  modified_base (434)..(434): a, c, g or t
gcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaagcggtaatacggttatccacagaatcaggggataacgcangaagacatgtgagcaaaaggccagcaaaaggccaggaaccgtaaaa

SEQ ID NO: 985 - DNA, 306 bp, Nicotiana tabacum
gggtgcaggatatggtactcttggaggtctcggaacaatttggggtgcctcttcaatttcgggtcaaggtggtggaaatggttcttttggcagtggcaacatcactaacagtggtgaaacaggtggggcagtgtatggacgaaactcgggcggcaatgctgtcaatacatcaccatatgctccagcaaaagacgttcacactggggcttttgggaacttgtatggtactgtaggtgcttcactttatgaggactcggcctggcgttcagcatctccagatactagatggctctgcttcctttggtt

SEQ ID NO: 986 - DNA, 263 bp, Nicotiana tabacum
cataacttgttacaacaagctctaaaactgcaagaatattaatactattacatcttacaagtacaaagcttcagtgaccttatccatggatggcctcacctttgtaggagcagcacctgctgcaaccataataattccggcggccgcagcaaccataataattccggcggccgcagcaaccatagcggcagtatcctccaccgcgtccgccacctccacgtccaccaccactgcgtcctccacctccacgtccaccacacccc

SEQ ID NO: 987 - DNA, 236 bp, Nicotiana tabacum
ttgtcaacaccaaaggaattcacttggtatacatctaaatatggattaccttagagaccctaggaattatagcaactcaagaactctgtcagaggatggacattgagaataatcatcaaaggagcaagaggcccatacattagaataccttatatagccaatgaggggactcagcacagaacatcatagcaagtgcaaatattgcagctggaatagtaggtacccaaaagcacccc

SEQ ID NO: 988 - DNA, 271 bp, Nicotiana tabacum
ggtgttgggaatgtctggagtggcagtatagtgggcgctacgccaccaacctgtatttatagattccagtatatgctgggtctgtgttggagtagctgaacggcctttcctgtttgttgaatttacctcatatgtttattgcagcaggaacttgagttgagacattagagattgctggtatatatttttaagatgcttgctcgttttgtacatgtttcttttagagtaggaccttaccgttgatttcccttcagcagattttagacgattt

SEQ ID NO: 989 - DNA, 259 bp, Nicotiana tabacum
  modified_base (212)..(212): a, c, g or t
ggtggttgacacgtggtaagcaacgactatggtggaaatagaaaggaggaaggaggagataggagaaataattggaaaaacagaagataatgcctctcacgcgcctcaacagtggggtgttacatacattatgctatgtcagcaatttgtgtctaattgacacaatttgcattcacctcaagtgttcaataggcactattattagttgaatntgtttgagtgaaaaatattgcccaagtttatggggccgcctatgtaa

SEQ ID NO: 990 - DNA, 399 bp, Nicotiana tabacum
gtgccgttgtggcgatgcggtagagtatggcaggagttgggacggagaataatagaggaagatgaataggtggttgcacagtggtaagcaacgactatggtggaaatagaaaggaggaaggaggagataggagaaataattggaaaaacagaagataatgcctctcacgcgcctcaacagtggggtgttacatacattatgctatgtcagcaatttgtgtctaattgacacaatttgcattcacttcaagtgttcaataggcactattattagttgaagtgtttgagtgaaaaatattgcccaagtttatggggccgcctatgtattctgtctttaattaaagtactgaaatatattgtaaattattagaggaaattagtaaaagattgaaatttcata

SEQ ID NO: 991 - DNA, 336 bp, Nicotiana tabacum
gtgcttatgctggaggagcagggggagcagcaggtggtggatacggtagtggaggtgagcatgctggtggatatggaggaggtgctggaggtggtgaaggtggtggacacggtggtggctacgccccttgattgctcattctaatcaccaattgaaatctaaaaatttccctattcatgcctacactactaaaaaataatgtaatcaaattgtggtgggaagatgatatatcgcgaaggcaaaagaaatgcagcaaggaaaggctgcatcttaagtgtattatcgtttcctttgatagcaaaattaaggtatatatgatgcttgcattttaagtaa

SEQ ID NO: 992 - DNA, 405 bp, Nicotiana tabacum
cgggtacgctctgctctctcgcgacccctactctaatcaaaagactaaaggcccctactgaagataggtcgccaaactacgaccgagagtttcgccttttgaagcgccagtcgcgtagggcgaccgggccaggccgagtcggataaggctttgatgactcaaggttcatattggggaaaggagagtgaggggaagagggggcagccctcggcccgatcatccaattgcgctccaacagacaggcatggttctgtagatcaaagcaacttcgtcactattcgtgtacctcggccgcgaccacgctaatcactagtgaatacgcggccgcctgcaggtcgaccatatgggagagctcccaacgcgttggatgcatagcttgagtattctatagtgtcacctaaataa

SEQ ID NO: 993 - DNA, 247 bp, Nicotiana tabacum
tataattattttcggagaagtatagtcaaattactgtgaaaaaacatatactactaatatttctcataccaaacataaacaatacatgcaaaattagttctctaaaaatccaataaagaagtttatgcccaattgaaccaagtgctttcgactgctgcaagtcaattccagcatgtgattatcaaaattgcataaaaactagctacaataaagataagatcaatctaagagaagcttgagctacggg

SEQ ID NO: 994 - DNA, 234 bp, Nicotiana tabacum
gaggaaaagaaggaagatgcccaaggaagaaagtgatgacgacatggggttcagtctgtttgactaggagctcctttcagtatgatatttggttcctttttagagaattgatgaaacttggtaatagcaccctttataaggagatttttgatctgtttgtcacaattaaatgtaatcttgaggttatgatttatgaacatctgtcatgtcagtaattgctacttattgtcgact

SEQ ID NO: 995 - DNA, 414 bp, Nicotiana tabacum
gtgctgcagttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttggtaatagcaccctttataaggagatttttgatctgtttgtcacaattaaatgtaatcttgaggttatgatttatgaacatctgtcatgtcagtaattgctacttattgtcgactccaatcatgtccctttattgctgtgacactttgaagtttccatgtgcatttgtagctgtattcttatagtaagtactggcgaggagaaaaccattcctacccttttcccaaaa

SEQ ID NO: 996 - DNA, 293 bp, Nicotiana tabacum
gttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttggtaatagcaccctttataaggagatttttgatctgtttgtcacaattaaatgtaatcttgaggttatgatgtatgaacatctgtcatgtcagtaattgctacttattgtcgact

SEQ ID NO: 997 - DNA, 442 bp, Nicotiana tabacum
gtggccttgtggggcatgggcgtagagtatggacggagttgggatcgagaataatagaggaagatgaatgtaattttgtggtgccctctttctattgaatgtttaagtgatttttaataaaaatgtttagtgttgtttgtaaatattttggtcactgaaattgaatttgaaatgtagaggtggttgtacagtggtaagcaacgactatggtggaaatagaaaggaggaaggaggagataggagaaataattggaaaaacagaagataatgcctctcacttcgcctcaacagtgggggttacatacattatgctatgtcagcaatttgtgtctaattgacacaatttgcattcacttcaagtgttcaataggcactattattagttgaagtgtttgagtgaaaaatattgcccaagtttatggggccgcctatgtattctgta

SEQ ID NO: 998 - DNA, 298 bp, Nicotiana tabacum
gtgctgcagttgctgttgctgctcccactggtggtgccggtgccggtgctgcagctgctgcccctgctgcggaggaaaagaaggaagatgcccaaggaagaaagtgatgacgacatgggattcagtctgtttgattaggatgctcctttcagtatgatatttggttcttttttagagaattgatgaaacttggtaatagcacccttgttaaggagatttttgatctgtttgtcacagttaaatgtaatcttgaaaggttacgatttatgaacatctgttatgtcagtaattgttaaaa

SEQ ID NO: 999 - DNA, 272 bp, Nicotiana tabacum
cgctggtggtggtgctggtgctgcagcagctgcccctgctgcagaggaaaagaaggaagagcccaaggaagaaagtgattgacgacattgggggtcagtctgtttgactaggagctcctttcagtatgatatttggttcctttttagagaattgatgaaacttggtaatagcaccctttataaggagatttttgatctgtttgtcacaattaaatgtaatcttgaggttatgatttatgaacatctgtcatgtcagttattgctacttaaaa

SEQ ID NO: 1000 - DNA, 282 bp, Nicotiana tabacum
ctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttggtaatagcaccctttataaggagatttttgatctgtttgtcacaattaaatgtaatcttgaggttatgatttatgaacatctgtcatgtctatgtaattgctacttattgtcgactccaaaa

SEQ ID NO: 1001 - DNA, 359 bp, Nicotiana tabacum
gtgctgcgcaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgagactcttgtggcaaatgcttaagggtgacaaatacaggcacaggagctcagaccacagtgagaatcgtggatcaatgcagcaatggcggactagacttggacgttaacgttttccggcagctcgacacagacggaagagggaatcaacgtggccaccttattgtgaactacgagtttgttaattga

SEQ ID NO: 1002 - DNA, 399 bp, Nicotiana tabacum; identical to SEQ ID NO: 990

SEQ ID NO: 1003 - DNA, 376 bp, Nicotiana tabacum
ataatacacttaaggtgcagcatttctttgctgcaattcttttgccttcacgatatatcatcttcccaccacagtttgattgcattattttttagtagtgtaggcaagaatagggaaatttttagatttcaaatggtgattagaatgagcaatcaaggggcgtagccaccaccgtgtccaccaccttcaccacctccagcacctcctccatatccaccagcatgctcacctcctccagcgtaggctccacctccaccggcaccactaccgcctccaccgcctccatatgctcctccatgtgctcctcctgcaccaccaccggctcctcctccactaccgtatccaccacctgctgctccccctgctcctcctgcat

SEQ ID NO: 1004 - DNA, 421 bp, Nicotiana tabacum
ctagatgtcaattcacaagtggctcttgaggcgaaccaacgttccgaaccggaaaaaagcattcagggcggtactcgatccgtagctcgagacacccataacgtgaaggagatcgaagtcagcttacgggtgatcttcgagatgttacaagcccagcaaatagcgataactcacttgcagagccaaactcaggaacaaagcaggccggagcccaatccgcttcgagaaatcacccacagaacggaaccagccatagtaaagtcaaacgagccagaatcggggactactcccgaaattactaaattgctcgaggaactcacaaaacgagtcgaagccgacgataaaaaagtagaaacatataattccagggtcgatcagatcccgggatctccaccaatgataaaagggctagattcgaaaa

SEQ ID NO: 1005 - DNA, 347 bp, Nicotiana tabacum
  modified_base (227)..(227): a, c, g or t
gtgctgcagttgctgttgctgctcccactggtggtgccggtgccggtgctgcagctgctgcccctgctgccggaggaacaacgaagcgaacaccccacaggaagaaagtgatgaccaccctgggattcagtctgtttgattaggagctcctttcagtatgatatttggttcttttttagagaatcgatgaaacttggtaataccacccttgtctaaggagatttccngatctgtttgtcacagttaaatgtaatcttgaggttacgatttatgaacatcctgttatgtcagtaattgttacttatcgctgtctcccaattatgtccctttattgctgtgaccatttt

SEQ ID NO: 1006 - DNA, 525 bp, Nicotiana tabacum
gtgctgcccgatactttaaggatgcttatgacaggggtcttacaccatatgagttcgtcgaaagtatgaagaagaagggcatcagagtgcctggaatcggtcacaggatcaagagaggtgacaacagagataagagagtggaactactgcaactttatgcgagggaaaatttcccttctgttaagtacatggaatatgcagttcaggtagaaacctacacactctcaaaggcaaacaacctagtcctcaacgttgatggcgccattggttccctcttcttggatctccttgctggaagtggaatgttcaccaaaccagaaatcgatgaaatagtagagatcggttacctgaatggtctgtttgtgctggcacgttctattggtcttatcgggcacacgtttgatcagaagagattgaagcagcctctataccgtcacccatgggaagatgttaatcactagtgaatacgcggccgcctgcaggtcgaccatatgggagagctcccaacgcgtgggatgcatagct

SEQ ID NO: 1007 - DNA, 294 bp, Nicotiana tabacum
gtgctgcagttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttggtaatagcaccctttataaggagatttttgatctgtttgtcacaattaaatgtaatcttgaggttatgatttatgaacatctgtcatgtcagtaattgctactaaaa

SEQ ID NO: 1008 - DNA, 176 bp, Nicotiana tabacum
gtgccttgtataatgatggttgatagtggtggtagtggttggttatagtggctggtagtggtagtactggtggttggtagtggtaatagtgattgttgtgcaatgatggctggtggtgattgtggacagaatggtggtgaaagttgattttcggaaaattctttaattcaatagta

SEQ ID NO: 1009 - DNA, 314 bp, Nicotiana tabacum
tcccatatagggtgaacataaaatcgcaaattaaaagtttcgtctaaaatctgctgaagggaaatcaacggtaaggtcctactctaaaagaaacatgtacaaaacgagcaagctcttaaaaatatataccagcaatctctaatgtctcaactcaagttcctgctgcaataaacatatgaggtaaattcaacaaacaggaagggcctgttcatgctactctgaacacagacccagcatatacttggaatctataaatacaagttaggtagctgacgcgcactatactcgcactccaaagcattcccagacacccc

SEQ ID NO: 1010 - DNA, 292 bp, Nicotiana tabacum
ttaattcattgagagcatctctcacaataactaagtcaactgaaagcacctaacaagggcttatttcaatccacacattgaaggccataattggcaatggttgttataaaaatgagatttctcctctccaaattcaaaatgtcactccaatacagttccacctcaatgaagctctctgtctagatccatttcctaattgaggatcaggttgagctcacaagaacaaatagtggcttatcacctaacctgtcccggcccttcaattctggcaactcaataagacatgcacccc

SEQ ID NO: 1011 - DNA, 315 bp, Nicotiana tabacum
  modified_base (104)..(104): a, c, g or t
gtgctgcgttgctgttgctgctcccctggtggtgccggtgccggtgctgctgactgctgcccctgctgcggtgagtaaaataaggaagagcccaaggaagaaangtgattatcatcttgggatttcatgtctgtttgatttaggatgctcctttcagtatgatatttggtccttttttagatgaattgatgaaacttggtaatagcacccttgttaaggagatttttgatctgtttgtcacagttaaatgtaatcttgaggttacgatttatgaacatctgttatgtcagtaattgttacttattgctgtctcta

SEQ ID NO: 1012 - DNA, 251 bp, Nicotiana tabacum
gtgctgcagttgctgttgctgctcccgctggtggtggtgctggtgctgcagcagctgcccctgctgcagaggaaaagaaggaagatgcccaaggaagaaagtgatgacgacatggggttcagtctgtttgactaggagctcctttcagtatgatatttggttccttttagagaattgatgaaacttggtaatagcaccctttataaggagatttttgatctgtttgtcacaattaaatgtaatcttgagga

SEQ ID NO: 1013 - DNA, 264 bp, Nicotiana tabacum
gttgaactaaacattagatgcaaattctgaaacttgttcaacaccagtggtgtgacaacaaaacattagaaagattcaacaaatactatgcttctccacctcccaaaacagaacaacaattacagcacacctccatccaccacacaaaataagatcaacatagcacatcatccctactactaaattttaataccatcactgtctttaacaaaaagatctaaaatcaccaacagagctaccacacttgatcaatttaagcacccc

SEQ ID NO: 1014 - DNA, 250 bp, Nicotiana tabacum
gtgtcatgggatccaaatcacaagccagaaccaaggcgaaagagagggttctcgccaaggaagcagcacagagaatgaactagagcttctattgtatgttgctgttggattaaacctctacctctaccaattttgtgcttttggttcgcatgcttgagcaatgttagagatcctacgtggattagacttttatatttactttgtgttacagattatgtttttatgcaaaaagactttcctactttgtcaa

SEQ ID NO: 1015 - DNA, 252 bp, Nicotiana tabacum
gtattacatttaactgtgacaaacagatcaaaaatctccttaacaagggtgctattaccaagtttcatcaattctctaaaaaagaaccaaatatcatattgaaaggagctcctaatcaaacagactgaatcccatgtcgtcatcactttcttccttgggctcttccttcttttcctccgcagcaggggcagcagctgcagcaccggcaccggcaccaccagtgggatgcagcaacagcaactgcagcacccc

SEQ ID NO: 1016 - DNA, 277 bp, Nicotiana tabacum
gtgctgtcattttggttgcttttcttttgatagcagtgaaagaaagaaagaaagaggcattgcattgggggcagaggaagagagtttttgtatactgagagtaacatgaaaaggggagaaagcagagactaaagatgcgctggctggtccagtcctgtctttgctcacttttgtttttctgccctttcctccttttactgtgttggagttggcgtgggtttgttgaatttgtccctcttttgctgatagatgtgagtttacaataaatggggttgtt

SEQ ID NO: 1017 - DNA, 234 bp, Nicotiana tabacum
gtgacaaacagatcaaaaatctccttataaagggtgctattaccaagtttcatcaattctctaaaaaggaaccaaatatcatactgaaaggagctcctagtcaaacagactgaaccccatgtcgtcatcactttcttccttgggctcttccttcttttcctctgcagcaggggcagctgctgcagcaccagcaccaccaccagcgggatgcagcaacagcaactgcagcacccc

SEQ ID NO: 1018 - DNA, 385 bp, Nicotiana tabacum
taatacacttaaggtgcagcatttctttgctgcaattcttttgccttcacgatgtatcatcttcccaccacaatttgattacattatttttatgtagtgtatggtaagatagatgggataatttttatgatttcaaatggtaattatgaatgatgcaatcaaggggcgtatgccaccaccgtgtccaccaccttcaccacctccagcacctcctccatatccaccagcatgctcacctcctccagcgtaagctccacctccaccggcaccactaccgccaccaccgcctccatatgctccgccatgtgctacctgcaccaccaccggctcctcctccactaccgtatccaccagctgctgctccccctgctcctccagcataagc

SEQ ID NO: 1019 - DNA, 320 bp, Nicotiana tabacum
gtgctgcagttgctgttgctgctcccgctggtggtggtgctggtgctgcagcagctgcccctgctgcagatggataaagaaggaagatgcccaaggaagataagtgatgacgatcatggggttcagtctgtttgactatggatgctcctttcagtatgatatttggttccttttatgatgaattgattgaaacttggtaatatgcaccctttattaaggatgatttttgattctgtttgtcacaattaaatgtaatcttgatggttatgatttatgaacatctgtcatgtcagtatattgctacttattgtcgactaaaa

SEQ ID NO: 1020 - DNA, 325 bp, Nicotiana tabacum
  modified_base (124)..(124): a, c, g or t
  modified_base (135)..(135): a, c, g or t
  modified_base (169)..(169): a, c, g or t
  modified_base (176)..(176): a, c, g or t
  modified_base (295)..(295): a, c, g or t
gtgctgcagttgctgttgctgctcccactggtggtgccggtgccggtgctgcagctgctgcccctgctgcggatggataaagataggatagatgcccaaggatagataagtgattgacgatcantgggatttcangtctgtttgatttatggatgctcctttcatgtantgattantttggttcttttttatgatgatattgattgataacttggtaatatgcacccttgttaaggatgatttttgattctgtttgtcacagttaaatgtaatcttgatggttacgatttatganacatctgttatgtcagtaattgttacttaa

SEQ ID NO: 1021 - DNA, 294 bp, Nicotiana tabacum
  modified_base (162)..(162): a, c, g or t
  modified_base (165)..(165): a, c, g or t
gtgctgcagttgctgttgctgctcccgctggtggtggtgctggtgctgcagcagctgcccctgctgcagatggataaagataggaagatgcccaaggaagataagtgatgacgatcatggggttcatgtctgtttgactatggatgctcctttcagtatgantantttggttcctttttatgatgaattgattgaaacttggtaatatgcaccctttataaggatgatttttgattctgtttgtcacaattaaatgtaatcttgatggttatgatttatgaacatctgtcatga

SEQ ID NO: 1022 - DNA, 333 bp, Nicotiana tabacum
  modified_base (136)..(136): a, c, g or t
  modified_base (171)..(171): a, c, g or t
gtgctgcagttgctgttgctgctcccgctggtggtggtgctggtgctgcagcagctgcccctgctgcagaggaaaagaaggaagatgcccaaggaagataagtgatgacgacatggggttcagtctgtttgactanggatgctcctttcagtatgatatttggttcctttnagatgaattgatgaaacttggtaatagcaccctttataaggagatttttgattctgtttgtcacaattaaatgtaatcttgatggttatgatttatgaacatctgtcatgtcatgtaattgctacttattgtcgactccaatcatgtccctttattgctgta

SEQ ID NO: 1023 - DNA, 359 bp, Nicotiana tabacum
gtgcatagggttgaactttggcatgttagaagccaagctcgcttatctcgaattctgcagctcttttggtttgaactttctccttcctacactcatgctccttacagtactctcattcttaaacctcagtatggtgctcacataatcttgcacaaactttgaccaatcgatcacgcgggcttgttattgtcatttccaataaggttgatcagaaatctagcttttgctatttatgcatttcagatacactatcattttatgaatttggatgtcatgatatgcttgttgttagaataaacgctttgtatttgtagtaaatggtatctgaaatagattgtactaatcaagatgtgaaccaa

SEQ ID NO: 1024 - DNA, 282 bp, Nicotiana tabacum
ttttggaggggatggtgttacattttgcaataaattcggcaaaaagacaaagttttcgaacgtaacacttcagaattaaaagttaaagagtaaaacagaaagtgactatttctatcccatccattataattatacactgtagtatacacgtcagaaaaaaaagaagaggaaacaccttggtttgaaaaatagacttagacaaaaaaaaaaaggacaaaaaaaaaacaaaaacaaaaataattacgatctagtaaccataataataagagttggatgatcaag

SEQ ID NO: 1025 - DNA, 446 bp, Nicotiana tabacum
ttttgcaataaattcggcaaaaagacaaagttttcgaacgtaacacttcagaattaaaagttaaagagtaaaacagaaagtgactatttctatcccatccattataattatacactgtagtatacacgtcagaaaaaaaagaagaggaaacacctgggtttgaaaattagacttaaacaaaaaaaaagacaaaaaaaaaaacaacaaaaataattacgatctagtaatcataataataagagttggatgatcaagttgaaaaaggcgagcttctggagccgtcaaaacatctgacgacgacagacaggagaattcaagaaagccgagagaaccatgttctggttcttgttacagagattcaatctttacataactgtgattgaaaatcgatagtgtgaatgatcaccatcaatatgctgacaagataaaacaaacaaacaaaaaaa

SEQ ID NO: 1026 - DNA, 401 bp, Nicotiana tabacum
tgcccgaggacttaacagtgtaagagcagagacagtgaaggagattgtgacttcctggttagtaacaattccagcgggtgctacctttgctgttagctacacatggatattcactaagctcttatcatacatactctgagtgtaaattaacggataacgccaccactcaaacttcttggattaataataaaatcacacagataaccttttttgtcgtgatttgagaaatgcaatttttgaaccttgtggaggatccatgataaagagtagtagtccattcagtttagaagacgaacaagctttgttttctgcctagcactttgcctccctatataagctgctaacttttgtgttggatttaagcaaatgtgattttgtttctttgtattttacttccaaaa

SEQ ID NO: 1027 - DNA, 449 bp, Nicotiana tabacum
gcccggactcttccgattacctcccataattgcttccctgcccttgaaattgtataatttaatgtgacatccgttggttttccagtgttcaggaatgaactacttacaacaaaactggatatggttttgagaaagggataatgtcactgcaagggtatttaatgtttcagatctgtggttggaattggaaactaatgttgctgcagctggtatgaacctccatagatttgtttcaagataatgaatgtgctaacgtagagatcaatgtttgacctgtttttctttcttattttctgttttgcccattcctggattgcgtgcttgggtttgcttgctttttgtttctttttccattcaacgtttttgtcctaccattccatgtattgtggacacggttagaaacccaaaacaatattttataatactaaacgaagatacttcgagcaaaa

SEQ ID NO: 1028 - DNA, 468 bp, Nicotiana tabacum
tatgaaaaactgggcgtgaagtaaaatggatgggtaaacctgataagataatatacagtcagctatgaaaatggctgctgaggatgcctctgattgtattgccataggagactccctccaccatgatatcaaaggtgcaaatgcagctggaattgcatccgcatttattacatgtggaatccatgctactgaacttggacttgacaaatttggagaggtcgcagatgataactctatacatgctcttgccttgcaaaacaatgcacatcctacatatgttatcccttcatttacatggtgaagaatgtgctatttgggcttggctaaaattttgtccctccagtgtttagcattgatgtgtccaagtacctaataatgctactcactttgtacctcttttgattcttttggatgaaatggtttttccgttaaccatctaatttgtctaaagggagtcttggagcaaaa

SEQ ID NO: 1029 - DNA, 401 bp, Nicotiana tabacum
tttaagtaagaaattagcagttgatgtcagccctgaaaatcaggagctaagaagtaaaagtattatataaacatccattaacgtaaaaaaaaaaacaaaaaaaaacatgagttgactgaagttgtctggaaaagggtacaaaattgtcgtgactgaattgaaaaaaagctgtcatgatggtcattgtacagcttctgccacttgaaggagcgggaacagaggcaggagatctggtctgtcaccaacagctaatgaaatgcactatcttaatcttctagcttctctttctgattccagaagagtgaggatgtctccttctcgcaccggacctttgacattcctgatgatttgacgattttgttctcctaaaaattcaactttgacttgggtacactgtccct

SEQ ID NO: 1030 - DNA, 415 bp, Nicotiana tabacum
acgagaagctaataaagctcttctaatgaaccgttaaaattgcttttcttgtagcattacaaaacacttctctctttaaatagaaagtttattacaatggcagagtaatattcttacaaaatagaattcatccatctctttcaggttagtgaaactgaaaccttcaattctaatgatggaaatcatatctccttgcgacattattcgatcaaccaaggttcttgaactggtgtccatgagcacagttcaccttctccaaaccaaagcgctatttcacgcttgccattgtcagggctatcacttccatgcaccacatttcttccagtttgaacagcaaggtctcctctgattgtgccgggctccgcgttaagtggattagttgctcctattagcttacgggcagatccgcctccca

SEQ ID NO: 1031 - DNA, 204 bp, Nicotiana tabacum
ggactcttccgattacctcccataattgcttccctgcccttgaaattgtataatttaatgtgacatccgttggttttccagtgttcaggaatgaactacttacaacaaaactggatatggttttgagaaagggataatgtcactgcaagggtatttaatgtttcagatctgtggttggaattggaaactaatgttgctgcaaaa

SEQ ID NO: 1032 - DNA, 284 bp, Nicotiana tabacum
cggcgaccaaaccccagtgaaaagctccggcagcagtctcctcacgcgccaccagaagctcacgcgcgtgagctcacgcgccggcgcgtacgaccacttccggccattttttgaaaatcttccttaagaacagttgggtcgcctggtagagttgtcccatccaaatgcagagcttagattactcgaagtcttctatcacaagatttataagatctttccgctcactgaaaagattgagaatataaatgaccagtattggacattgcgggcagatccgccgccca

SEQ ID NO: 1033 - DNA, 424 bp, Nicotiana tabacum
  modified_base (84)..(84): a, c, g or t
  modified_base (87)..(87): a, c, g or t
ccttttttgcttccctgcccttgtaatagtttataattttagtgtcatccgttggttttccgatgttcaggaatgaactactancancaaactgattttggttttataaagggtaatgtcactgcaagggtatttaatgtttcagatctgtggttggaattggaaactaatgttgctgcagctggtatgaacctccatagatttgtttcaagataatgaatgtgctaacgtggagatcaatgtttgacctgtttttctttcttattttctgttttgcccattcctggattgcgtgcttgggtttgcttgctttttgtttctttttccattcaacgtttttgtcctaccattccatgtattgtggacacggttagaaacccaaaacaatattttataatactaaacgaagatacttcgagcaaaa

SEQ ID NO: 1034 - DNA, 546 bp, Nicotiana tabacum
cgggcccttgagagtatcaatagcatacctgccgctgtatagggaatgtgtcaaggcagggggttgcttgttatcacaaaggcttagggggcagctcgtggaagcagcgaaaaggcttgacggcgtcgtgttggaagaggtaaaccagggaagagaattattggctgttttggagcatcatattcccccatttttggtaaatgcatccaatggtgcttaggatgatagcatcttttagattttgaaaaaatttcacctctcttcactctcccttcacaaagtacaataacacaatagttggtggggttgaaggtgagcaaaatgtcctcaaggttggtcaattatctgaatgaaccagttgttggcttagatacataaatctgcagggagttgtacaatgcatattctgatgtgtatgttgagtaaactacattcagaaggctggtaacgcgaatgggcatacacgtaggctatttcgtggcgcttctccttctttatccggtgttacactaaaccaataaatacatgacatgtctttcaataaaa

SEQ ID NO: 1035 - DNA, 605 bp, Nicotiana tabacum
cggaggaagcggcgagtcggccacgctgatttttccagtttgtgcatcaacagagaacaagagaggcttactcgtcgagctcaggttccctcgctgcagatcgtaaagcaccatcccgtttcgccccaaatctgggtcacgtgcctccacctttccgacaacgtgaccgattggagcattttgagaaactgtaaattcgtataaattcgttggcgcaaacacaggattattatcgttggcatcgagtaaggtcacctcgaccgaaacaaaggagtcactctccaaattcgttgaaatgaggaaggaagtttctctctcgcgtaaacacgcatgccgagagacggttttgtctcacggtccaatttcgcttgatttctcacagttaaccaaccagaatgactgtcaatactgaatgcttggcttggatccaccagatgatagataaactcaccattgtcaccctgatcttggtcggatgcaacaacttgtaggacactgaacccgttcggtaaattttcgacgatacttatatgtaaacgtccacctcaattgtggctggttatcgtgatgtccagcaattcaacttctacacgggcaacaccagc

SEQ ID NO: 1036 - DNA, 517 bp, Nicotiana tabacum
cggtgtttcaattgccatcatgggttgcattgtgaatggacctggggagatggctgatgctgacttcggatatgttggtggtgctcctgggaagattgacctttacgtcggcaagacggtggttaaacgcggtattcaaatggagcatgcaacagatgccttgatccagctaattaaagataacggccgctgggtggatcctcctgctgaggagtaagatcaactggaagagttaacagataacaattgcattgtaaatgcagattctagcacctgataataatacagcatcagcaaactccagaaagctgccatttccaagcagctgagatgtagctttttatgttgtttgtagaatctagtacatgcatgcaaatgcagaatattcatgtattaatcaattctagttaccagtccccttcttgggaatctagtaacaggctatatcattgttcattaatgaccgatctacgtagtgagggcagcccggtgcactaagtatttcgcattcacgcag

SEQ ID NO: 1037 - DNA, 408 bp, Nicotiana tabacum
cgtaagctaataggagcaactaatccacttaacgcggagcccggcacaatcagaggagaccttgctgttcaaactggaagaaatgtggtgcatggaagtgatagccctgacaatggcaagcgtgaaatagcgctttggtttggagtaggtgaactgtgctcatggacaccagttcaagaaccttggttgatcgaataatgtcgcaaggagatatgatttccatcattagaattgaaggtttcagtttcactaacctgaaagagatggatgaattctattttgtaatgatatattactctgccattgtaataaactttctatttaaagagagaagtgtgtttgtaatgctacaagaaaagcaattttaacggttcattagaagagctttattagcttctcgttccaaaa

SEQ ID NO: 1038 - DNA, 326 bp, Nicotiana tabacum
cggctgccacagaggaggctttgcactctacaaattaatgttacaaggcgcgaatgatagctaaaaaagtagtctttaggcataaataacttttatgccaaaaagcaataagttggggttgctagcttactggtttggcttgttttaacttttaagcagtttttaacttattttaagtattttttaactttgtcaaacactgaaaaaagctagaaagagcttaaaagctgatttgaccatgttaaaagccaatccaaacactctcttcgtcatattgaaccacaagtttgcttctttactttactatgtattgagctgtatcaaaa

SEQ ID NO: 1039 - DNA, 302 bp, Nicotiana tabacum
cgccgggaccgcggacgcgtcactcccgacgccggtcagacgcgccgtcgggcaggcaatcgccgggaactcgttccgggcgaccctgccggcgttagtcgcggcagaaggggccgaccaaccccgggaggttatcggggcgcgctacgccggccggggcaactcggacggcgcgctgctcccgtctcccaaacgctcagagtcgccgctctaaccggtggcggccgggcaatcaacgaccgcgccaacaaaccctggtcgtgctcagaactgttctcggacccgggcaaatccgcctccca

SEQ ID NO: 1040 - DNA, 354 bp, Nicotiana tabacum
cgctcaattgccattgcttgtccagcattgccttgccttgcccatgtctttgcccctgcttgacatggctttgccttggccattgctatgccaatccgcacgtccaagtttaatgcaccttgcttcagttcaaggtgcgtttgtcaaccccgcatagtccgtcatgccgagcagcccatcatgatgttgtcccaattttcaggttgtgtgccaaggccatcatgaaaatccttgtcacaacccacacttgcttgtcagagaaatgatttaaggtttgcaattattccagaaaactcagagagagcattttgctatgcttattgagggatcaaacccgggcagatcctccgccca

SEQ ID NO: 1041 - DNA, 233 bp, Nicotiana tabacum
cgtccggaatcctcttcagagagaactacaactgcccggcaagagagccgtacaccccacgctactacatcaactagactcgttccttagcggatattcgatgtttaagaagaaccaggcgacaacgaaatgggagaaacatagaaattgagattaatcgcaaactatgaaaatatgcttgaaaaaagtaaaaagaaagaaactcgaaataaaaaaaggttcaaacagcaaaa

SEQ ID NO: 1042 - DNA, 369 bp, Nicotiana tabacum
cgcaaatgctagattgaacattgttaagggcacaagcgtccctgtcgacatatactctctgaactccggtcatcaaggagaaaacacatcttctgtttcaccatgaacaatgtctagtacatgtatacggtataccatcttgtaaatacatcgccttggaattggagagttttttccattgtacttttaagatataaatcaaccatgtacatataccttgatgtacatgcaacttctgtattggagttgataggactaagctggtgacacagctcggccttccactttggtttttgactctgtcgtgaaaaagctatatgttgtactttcctggaaattatactaaaactgcatgttgaaagttcaaaa

SEQ ID NO: 1043 - DNA, 405 bp, Nicotiana tabacum
cggcaaattcaagatgctcgaatcagcaattagtgtgaaccagcaaatttaattaccggaggacagtcactgaaccgaatgaaatcgatacgaatctaaagaccgaatccaagaatctatctaaaaaagctttaagctttgtgtcaaggttgcaaaataggcttaaataaaattacacttgttttcttgatttggccatcttgagtctgccgcgtaaatagtatccttggtggacaaatagctgggggaagagtatctaacggtgatgtcaacaggcatttttttttattttttattttgttggtttgtttttgttattgtttttcttgtcggagtgaattttggaagtttttagtgaagcctcggcgttgtaaataattatgtttactcattttctgaagaaat

SEQ ID NO: 1044 - DNA, 436 bp, Nicotiana tabacum
ggcagctgctccaactcctttttatcatgagcaggaagttcaggagcacaatacatcacgtatctatagaaacatataccaaagcagaagctcaaaactaaagctctagctaataatcctacgttcaacatgtaagtaagaacctgcattactaatcccaacattacatctattcccttaatatcatatgctacgcgcaagaagtgcgcataggtatagaaatatccggtgcagcttactaatagagtgagatacccataattgaactccaaaaggtgatgcaaggctgcagcagtaaccagaggaatggcctcgatcataaatttagccttggcaccaattaaacggaaaggcatgtcgcgatgccaataaacaacagagtacaacacattgatatgaagtatatagccacaacccgggcagatccgccgcccaa

SEQ ID NO: 1045 - DNA, 467 bp, Nicotiana tabacum
tggaggggatggtgttacattttgcaataaattcagcaaaaagacaaagttttcgaacgtaacacttcagaattaaaagttaaagagtaaaacagaaagtgactatttctatcccatccattataattatacactgtagtatacacgtcagaaaaaaagaagaggaaacaccttggtttgaaaaatagacttagacaaaaaaaaaaaggacaaaaaaaaaaacaaaaacaaaaataattacgatctagtaatcataataataagagttggatgatcaagttgaaaaaggcgatgcttctggagccgtcaaaacatctgacgacgacagacaggagaattcaagaaagccgagagaaccatgttctggttcttgttacagagattcaatctttacataactgtgattgaaaatcgatagtgtgaatgatcaccatcaatatgctgacaagataaaacaaacaaacaaa

SEQ ID NO: 1046 - DNA, 624 bp, Nicotiana tabacum
agcgtacagctacatggggtccgggtggggttgctttcttcaccctgaaagcaacagtgacgaaaaagcttatatgtgcctatataggataacgcttgagcaatttaatgatgttttacttcaagagaatgtttcgaactttgacatgaactcccctttgtttgacatgactgacttacaatctattgaaaacagcaaatgtgtttcagcagaggctgtcaagaatggctggtaccataatgttctttaccttgggaaggagaatggtcttcctattttgacaatgacatgccgactctcagatattgataacttcaaatcaggtaacgtacttacgtgcaaaccatctaaagaatatgccaataatctgattagagggttggtagaaggaaagcagctctcggaagaggaagccaccacttacatacaagaagcagctagcagagcattgtgagttgtgactacgttttccttcttgtttctttagctgctagataattatgtgactatgcctcacaacatatgctccggaactgttattgtaccattattttttgatgaagcaactgctatcatttttttcagtccaggtgtatataacttataacatctgacatagatgtt

SEQ ID NO: 1047 - DNA, 451 bp, Nicotiana tabacum
cgtcggtacatgaatgcaaaactaagaagctgctctagcgagacatgcgaattcagtggcacatatacagatctgcgtaagcacgctaggcaggagcatccccttgtacggcctacagaaactgacccagagaggcagcgtaattggcggagattggagcggcagagagatttaggagatttactcagtacattgcagtcttctgttggagaagagggaagtgagagcaccagtttaaccttcgatgagggtggtggtttgctgactgtttttctttttgttcggattctccaacctaggagtaattctggtagtaatagctggtcaggctcctcaaggactcgggctcaggcaactggtaggagacgatccttcgagaagactttggggtgagacctatgatgggggataactgaatctagagatgacgacaatgaacagtctgatggaa

SEQ ID NO: 1048 - DNA, 302 bp, Nicotiana tabacum
gttgaaaaaggcgagctctggggccgtcaaaacatctgacgacgatacacaggagaattcaagaaagccgagagaaccatgttctggttcttgttacagagattcaatctttacataactgtgattgaaaatcgatagtgtgaatgatcaccatcaacatgctgacaagataaaacaaacaaacaaaaaaattaaaaaaaaaaataaataaaacctgtcaacagttgaactttgaggtgaagaattagaaaagaaaagagagggctggagttcaaaggagttgcgggcagatccgccgccca

SEQ ID NO: 1049 - DNA, 135 bp, Nicotiana tabacum
cgcacaaagatggaccacgaggagtacctcaagcgagtcaagagctacatcaagacccccacacccgagattgagcagcagctcgaggacttctgcaagaacaccacctatgtgtccggacagatccgccgccca

SEQ ID NO: 1050 - DNA, 446 bp, Nicotiana tabacum
cggactcttccgattacctcccataattgcttccctgcccttgaaattgtataatttaatgtgacatccgttggttttccagtgttcaggaatgaactacttacaacaaaactggatatggttttgagaaagggataatgtcactgcaagggtatttaatgtttcagatctgtggttggaattggaaactaatgttgctgcagctggtatgaacctccatagatttgtttcaagataatgaatgtgctaacgtagagatcaatgtttgacctgtttttctttcttattttctgttttgcccattcctggattgcgtgcttgggtttgcttgctttttgtttctttttccattcaacgtttttgtcctaccattccatgtattgtggacacggttagaaacccaaaacaatattttataatactaaacgaagatacttcgagcaaaa

SEQ ID NO: 1051 - DNA, 309 bp, Nicotiana tabacum
cgtaggtgtagtaaaggttttcgagatcctgtggcccttgtggaacatgttgaaagggaacataaaggaacttctaaggcttagagatggaggtacatgtaaagaagcaaaagtacataatacctttttcttgttaattctttttcataaacaacaagtctatttattcttacactaaattttctcgtgaagaggggatgttctgatggtaagcaacctccacttccaaccaagaggttgtgagttcgagtctacccaagagcaaggtgggaagttcttggagggaaggatgccgagggtctatttggg

SEQ ID NO: 1052 - DNA, 343 bp, Nicotiana tabacum
agcagctcaagaattacagaaacactctgctttcggtttactctttccacgtatgaaggataacgagaaataatctggtttattatgaaacttatcaaattagaatatacaagatgcagcaggcttcagagtaaaaaccaacgaagtccctcctgagagagttgtattttgtccaaagtcgatgcaatgtggtatacatcaaagaagacctctcaagaaagctgtacatccagttgcaatcacagatcaggagggaatatagaaagtttgaacccagtcttctcggtcccttgaggttgcttgtcctttttgtattgtagttcccgggcagatccgccgccca

SEQ ID NO: 1053 - DNA, 311 bp, Nicotiana tabacum
cgggttgttgctttttacttcatatcaatgtgctgtactctgttgtttattggcatcgcgacatgcctttccagttaattggtgccaaggctaaatttatgatcgaggtcattcctctggtaactgcagcagccttgcgtcaccttttggatttcaattatgggtatcctgctctactgctaggctgcaccggatatttctgtgcctatgtgcacttcttgcgcgtagcatatgatattaagggaatagatgtaatgttggggttagtaatgcaaggtcttgcttacatgttgaacgtagaattattagta

SEQ ID NO: 1054 - DNA, 425 bp, Nicotiana tabacum
  modified_base (277)..(277): a, c, g or t
cggtggtttagaggactttttggaaattcttagggcgttttttggaaacaaagtttatgatgtgaagcatatgatgaggttctgtaatagcctctttggtgggttagaccgagttgcgagtacattggctgtggacagagcggtcggtaaatgccaccaggccggttcagatagcttgttgacgtggcatgcatttcagaaaatgagggatatttatttcgtaaaagacgggccagaaaaacacgctggagtcttgtatggattagaagcttactanggatgaaggggatcactaattgtgtaattgttagtaaataaaagctatttaattcattctttttaattgaaactttggtcctgtgaatttagtttaagtgctattggaaaaggtttaatgagttaaactcctttcatcctaagttcta

SEQ ID NO: 1055 - DNA, 599 bp, Nicotiana tabacum
gtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccatacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaacccgtaaaaaggccgcgttgctggcgtttttccataggctccgcccccctgacgagcatcacaaaaatcgacgctcaagtcagaggtggcgaaaaccgacaggactataaagataccaggcgtttccccctggaagc

SEQ ID NO: 1056 - DNA, 564 bp, Nicotiana tabacum
  modified_base (76)..(76): a, c, g or t
gatcgcaatcaaatacacttaaatatggcagtgaagatccacgacaaacaacatccaagaaagaggaactcgcgantctcgaacggacctcaactggcaagcaatcgacgatctcgagcgacctcgattcaataccgaaactcaaattgaaactcaaaaattgaaaagcagtaaagggatgaaaacatatattttgtgttagttttttcggatctttccgaaaataaaggactcaaaataaaaacctaaaaccctagctttttctgtcaagaaataccctctttcaatctctgtccagacccaaatatatagccctctctcgaagcttctctccttcctttgcaagaaatagcaaaaacccttcaaaaatccgaaaatcccaccaaaattctgaaaatttccttctttttggtaaaaatctggacaaatggaggggtatgattaattttcattaatcatatcctacccttcgtccatcatctatcgttgaaagagattcacgtatgagagagcaaaatacaacgtagattcgaaccaaaatcggttatttgtcaggccacgtgg

SEQ ID NO: 1057 - DNA, 521 bp, Nicotiana tabacum
cgcatcaattgccattgcttgtccagcattgccttgccttgccatgtctttgcccctgcttgacatggctttgccttgccattgctatgccaatccgcacgtccaagtttaatgcaccttgcttcagttcaaggtgcgtttgtcaaccccgcatagtccgtcatgccgagcagcccatcatgatgttgtcccaattttcaggttgtgtgccaaggccatcatgaaaatccttgtcacaacccacacacttaggttgccagtttgatgatttgttattaccagcgtacaattggtgaagcctcaacgaattgaccaaccagtaaccatttaatgacttcttctggacgtcaatcaaattgctggaaaaaacatcttccatataactgcttttcagaggtgtgattatggtcaaacttgtctcgattggtactatgtttgattgctgaatttgtatgtggaataaactttggtgatgtagattgtagcatcacactgaggtagttgcttgtcagagaaatgat

SEQ ID NO: 1058 - DNA, 471 bp, Nicotiana tabacum
cgggttgtggttatatacttcatatcaatgtgttgtactctgttgtttattggcatcgcgacatgcctttccgtttaattggtgccaaggctaaatttatgatcgaggccattcctctggtaaccgctgcagcgttgcatcaccttttggagttcaattatgggtatctcgctctattagtaagctgcaccggatatttctatacctatgcacacttcttgcgcgtagcatatgatattaagggaatagatgttatgatgggattagtaatgcaggttcttgcttacatgttgaacgtagatttattagttagagctttagttttgagcttctgctttggtatatgtttctatagatacgtgatgtattgtgctcctgaacttcctgctcatgataaaaaggagttggagcagctgccttgttgatttgaattatctgagtataagttaattgagttattttctcttaaaa

SEQ ID NO: 1059 - DNA, 595 bp, Nicotiana tabacum
  modified_base (447)..(447): a, c, g or t
  modified_base (449)..(449): a, c, g or t
cgcgttcacaaggaactccagacgatcccatatgcaccacttgttgcgcaggctacaagggctgcaactattatagcgctaatggaacttttatttgtgaaggatcgtctgaccccaaaaatccaaacgtttgtccccagttttgatccagatattgcctattcaaaatgcccgcgttcagaaggatgatgacgataattaatcccaccggatgcactacctgttgcacgggatacaaaggttgctactacttcggtcaggatggcgatgtttgtttgtgaaggatgatgagtgatgaacccaagatgttgtactacggaatgtgaccctagagttgctaccataagttgcccgttttctggattggtaaagattaatcaagaatgcatcaactgttgtaacgcagacaagggttgcgaactctatgataatgatggatctttaatntngtactggtggggagcctcaaagtgctgcttaattatttctaatcagtgatctgtagttattgtacatgaaataaaagcatgatagatatatatatgcactgtcatgctaaactctgtaatgtgggcagtggagatgttttccacag

SEQ ID NO: 1060 - DNA, 421 bp, Nicotiana tabacum
ataattgcttccctgcccttgaaattgtataatttaatgtgacatccgttggttttccagtgttcaggaatgaactacttacaacaaaactggatatggttttgagaaagggataatgtcactgcaggggtatttaatgtttcagatctgtggttggaattgaaaactaatgttgctgcagctggtatgaacctccatagatttgtttcaagataatgaatgtgctaacgtagatgatcaatgtttgacctgtttttctttcttattttctgttttgcccattcctggattgcgtgcttgggtttgcttgctttttgtttctttttccattcaacgtttttgtcctaccattccatgtattgtggacacggttagaaacccaaaacaatattttataatactaaacgaagatacttcgaga

SEQ ID NO: 1061 - DNA, 550 bp, Nicotiana tabacum
cggtcgtactcataaccgcatcaggtctccaaggtgaacagcctctggtcgatggaacaatgtaggcaagggaagtcggcaaaatggatccgtaacttcgggaaaaggattggctctgatgggctgggcacgggggtcccagtcccgaacccgtcggctgtcggtggactgctcgatgctgctcccgcggcgatgatgcgggtcgccgcgtgccggccgggggacggactgggaacggttccttcgggggccttccccgggcgtcgaacagccaactcagaactggtatcggacaaggggaatccgactgtttaattaaaacaaagcattgcgatggtccctgcggatgtttacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagcccaagggaac

SEQ ID NO: 1062 - DNA, 395 bp, Nicotiana tabacum
aggactttttggaaattctagggcgttttttggaaacaaagtttatgatgtgaagcatatgatgaggttctgtaatagcctctttggtgggttagaccgagttgcgatgtacattggctgtggacagagcggtcggtaaatgccaccaggccggttcagatagcttgttgacgtggcatgcatttcagaaaatgagggatatttatttcgtaaaagacgggccagaaaaacacgctggagtcttgtatggattagaagcttactaggatgataggggatcactaattgtgtaattgttagtaaataaaagctatttaattcattctttttaattgaaactttggtcctgtgaatttagtttaagtgctattggaaaaggtttaatgagttaaaaa

SEQ ID NO: 1063 - DNA, 422 bp, Nicotiana tabacum
cggtgtttcaattgccatcatgggttgcattgtgaatggacctggggagatggctgatgctgacttcggatatgttggtggtgctcctgggaagattgaccttacgtcggcaagacggtggttaaacgcggtattcaaatggagcatgcaacagatgccttgatccagctaattaaagataacggccgctgggtggatcctcctgctgaggagtaagatcaactggaagagttaacagataacaattgcattgtaaatgcagattctagcacctgataatatatacagcatcagcaaactccagaaagctgccatttccaagcagctgagatgtagctttttatgttgtttgtagaatctagtacatgcatgcaaatgcagaatattcatgtattaatcaattctagttaccagtcccaaaa

SEQ ID NO: 1064 - DNA, 276 bp, Nicotiana tabacum
gcactcagaatctagaaataaaagaagagatcatcagccaagcttgtatggttctcatctataatattcatcctattctgttcttccccatccctatccactgaacctcgatcagactcatcacttgaaatcaacggcacagattgattcacaacctcagatagctgttcctttacattcgacggtggataagaagccacgtgtccatcattcaaatcctccatctcctctaatttgcccttctgctgaccactcgccggacagatccgccgccca

SEQ ID NO: 1065 - DNA, 484 bp, Nicotiana tabacum
cggcggcgacatcggtatccttatggagtacatgaacgtcggcacactagaaagtcttttaaaatcacaagcaactttctccgaacttagcttagcaaaaatcgctaagcaagtacttagcggactcgactacttacacaatcacaaaatcattcacagatgatttaaaaccttcgaaccttctagtaaatcgcgatgatggaagtaaaaatcgccgatttcggatgtgagtaaaatcatgtgcaggactttagatccttgcaattcatacgttggaacttgtgcttatatgatgcccagaaaggtttgatccagacacttatggagttaactacaacggttacgcagctgatatttggagtttgggcttgactttaatggaactatatatgggccactttccgttcttgccacctggacagagaccggactgggctacgctaatgtgcgccatatgcttcggtgagccgcccagtttgcctga

SEQ ID NO: 1066 - DNA, 535 bp, Nicotiana tabacum
cggaagatcagctagaaacacattagaaaaatctcgtactactgggactgaatcaactgtaggggtatcaatactgacatctctctcaaaagctagatacgttttacaccccttctcaaccatacgttgagctttaaggaaagaaataactctactggaagtatgacctaaggtacctctccactctactcacaatacacctggcatagccagcgtcacagttttgccgtgacaatcaaaaatagcataatgggcgacaatcagtccatgcctaagataacatctttaatctaccatgctgagcaataacaaatcgactctggtctcaaaaccactaagagcaaccatacacgaccgataaacgaaacataaacagggaaactcaaagaatctcgagatacacccaaatgcgaggcaaaataagaataagtggagcctggatgaataaatcgatgcatctctatgacaaaccaagacaatacctatgatgacataatggcgatgacagcctcggtacgggcagatccgccgccca

SEQ ID NO: 1067 - DNA, 212 bp, Nicotiana tabacum
ttttgaaactaaaagagttgtctcttataacaacttacagaaatgcttagcaagttcttaggagtacaaaatactagcagaaaacaagaagaatgatcacaacaaatgactaaacaaacacttttcgataaaatgctggataggaagcaggcgactttctgcgtgctgctattgggagcgtcttcacttggtgtagagaacatcttcccatt

SEQ ID NO: 1068 - DNA, 382 bp, Nicotiana tabacum
cccagctgaccgcaagactgcatgcacttgcctgaaatcagctgcttatgctattaagggtattaatatgggcaaagccgctggacttcctagtgcttgtggcgttaacattccctacaagatcagtccctctactgactgctccagggtccagtgaggttgatgaaagacagtttctctacgaacaaatctgaaagtagcgcaatcataataagaagatgatcctgcttatggatccattactatgtatctgttgtctgtttctttttatttgagtcttttcgagtactcatagtcgagtcttgtaacgaaacttcagcggttggttggttttacaatccaatcttgagacttgatatatagatatcttatttagttaaaa

SEQ ID NO: 1069 - DNA, 407 bp, Nicotiana tabacum
tgttgagcaccgtgtatccggcgctgaaaagagattgtttaagtcaccaaattcagaaaaaaacaaggcccgcactcaatttctaaacaagcaaaggatgttgtcccaggacaagaatgttggctactatacggttggtgatgtgtgaaattttcagccaaagccaacctggaacaattgtccgtgtcaaaaatattcattcatagttgcagatttgatgaacaaaatgataaacaaaaggatagttacttgatcattttgttgcctacttggtagtagtcctttatttttcttttacagtaagtatgaattagattggacttggtgcctccacttcatgtagtgcatgaaaaaggccagccactgtgcattctcttatgtttctattgaaacagattctcttaaaa

SEQ ID NO: 1070 - DNA, 456 bp, Nicotiana tabacum
cataactaagatgttctccaacgagatgacattagcttctgcatggattcacttgttggccgtagatctttttgctgcaaggcaggtttatcatgatggattgcaaaatgatattgaaacccgccattctgtgtctctgtgcttgctgttttgccccttcggaattgttactcacttcatcaccaaagctctaaccagtagcccagaaaagagacagcataggactcattaaccaaggatttaggcctttataaatgatcagcctgtgtgtgactatcagcaaagtgcaaaggttttcagcaatgaaacacaacagtagaagcttgtattcttgtaataaaacattgatatagcttgtattcttgtactacaacattgatatactgttgatccaacttcgataaatctaacttgtctctaagatggatgtatgtataagacttcttcctttaaaaa

SEQ ID NO: 1071 - DNA, 540 bp, Nicotiana tabacum
ctaaatctgaagcaaccaatttcgaaagtacatatggtgagccaattccagtgaaagaacttgcggaacgcgttgctagttatgtgcatttatgcacactgtattggtggctcaggcctttcggatgtggggtgattcttggagggtatgatagagatggacctcaactatacctggttgagccttctggtgtctcatacaggtactttggtgctgctattggaaagggaagacaagctgctaaaacagaaattgaaaaattgaagttatcggagatgacctgtcgacaaggggtgattgaggtggccaaaataatttatggagtacatgatgaggcaaaggacaaggcatttgaacttgaaatgagttggatatgtgacgagtccaaccgccaacatcagaaggttcctgatgatattttagaggaagcgaagactgcagctaaagctgcccttgaagagatggatgcagattagtgatcctaatacactaagtactttctttcttcttgcatctgttctcatgtccttattgaatggt

SEQ ID NO: 1072 - DNA, 454 bp, Nicotiana tabacum
ctcgacgtttttcaagcacaaaatgttcagagcaaaggccttcctttaaaattcttaatggtgaattcaagttcagggctagtaattgacgaaaatgaagacataaatatcaaatttgcagcaccaagatacgtgtctatttgcaataaaaccactgtttggaaaattgaagatgggtttgtgaccactggcggaattaagggtgggtctgaaaatggcacggccacaagtttgtttactattcagaagtatgaagatgcctatgcgttacagtattgtccaagagctacagggtgttcttttatttgtccaagattgttgtgtgggtatattggtattgcaccagcgaataatggatcgaggcgtttggctgtcaatcgtccggttttcaagattttattccaaaaggcttagcatacagagggcggactcaagatttttcttaattaaatat

SEQ ID NO: 1073 - DNA, 447 bp, Nicotiana tabacum
aaaagcaaaagcactcaaggctgcctcctccggcttgaaacaaactgggacaaaaaggaagctggacaaccgaacacctgacactgcaggcagaaagaagaaatgggtagaaaatcttaggtcttgtatttgtccacaaagttgttatacatgagatagtgttcattcatatgttcacttctcggattgtggctgtcagtttcatgtagaactaaattgtgtacaacttgccccctcattaaccaaagtttacactattgattctgttttctgtctgagattatctagattgctgttcacaggtagtaaacagtcgtccaaatttcaaagtacccaattgatggcttaatgccattgttaaacttgaaaaaaaaaaaaaaaaaaaaaaatcactagtgaattcgcggccgcctgcaggtcgaccatatgggagagctcccaacgcgt

SEQ ID NO: 1074 - DNA, 411 bp, Nicotiana tabacum
tggacatcaaagatatcagggtggtgataaactatgacttcccaactggaatagaagattatgttcacagaattggtagaacaggccgggcaggagcatctggtctggcctacacatttttctccgaccaggattctaagcatgctttagatcttgttaaagttttagaaggtgcaaatcaatgtgtgccaactgagctacgtgatatggcttctcgcggtggtggtatgggaagggctaggaatcactggggttctggcccaggtggacgtggaggacgtggtggaccctataattccagctatgttggacggaatggaggacatggttatgaccggggatcacgtgacagtgacagatatggtcatggtacctacaatgcggatgctccacggaagcgcagtcgtagca

SEQ ID NO: 1075 - DNA, 503 bp, Nicotiana tabacum
ttttcaagtgcttcagtcattgctaccgtggctgattctgtttttcagaaagccatttccctttacaagaagaggagagaagaaattaaactcgtaaacgatgtgaaatgttcgttttctggtcggctaggtgagtcctatccagcaactaaattagagaattcaagttcagattatgttaaagttgaggagactgctccagtggataatgcgctagcagaagatggttctaagggggctaatctccctgttagttctgaggaagttgtagggctttcacaaaccaccacctgtaacgagctgtgtgagccaatgagtctgaacacagctgagaaatcagatctccctccttccgtggtggaaagagttggcatggacggggataccgttccggatgtggctcaggaaattaaaatggaagagaactcctcgtctctcggagaggtgggtagatctgatgcccctgcacctcaggtatctaaagatttgataatgaccgacat

SEQ ID NO: 1076 - DNA, 422 bp, Nicotiana tabacum
aaattggtgaatctgctgcagaaggagcaattagggaaactctagaagaggcaaatgcagaagtagaggttcagtcaccttttgctcaattagacatccctcttataggccaaacgtacatgatttttttggcgaagctgaaaactccccacttttcaccaggtccagaatcatcagaatgtcggctttatgagcttgatgatattccttttgattctttagcattttcatcaatgctggtgaccttgaagctgtacattgaagatattaaagttggaaggccgaagtttcattatggcatcattaacaagaggcctggtacaagcccttctgaaatccatgcctacactctggattatcatatgcaatcctaacaagcatgtaagttcttttccaaggtcactttcacctaagaaagtaga

SEQ ID NO: 1077 - DNA, 506 bp, Nicotiana tabacum
cggtgcaaaattgtgtgcagtagtagagtcacttaaatttctcgtggacgtatgtgaaattgggcagttagcgccaatcatgctgtccacttctcatatacaaaattcatgcccccttttttgatccccctttttttttttgttgttgggaaatcacaacttttgagtcttgtgaatgggtacccagtccttggcgccaatctgatgaaaagttatgtatatattagatcggtgtgtagtgacagcagctacctttgctgcattatttattttgtgcaagggcatatttccagttttttttttttttttttttttgggcaacaattgtcaaatgaatgtttgctaactatggctgagtacaaatatttgagaaggaaattttctagaacaagacttctaattgaaaccatcagtctgcatgctgttctcatgagctcaactcaataaaaaggctggcctgaggatgtaatccagcatctttaagggacaaagaaagcttctctgcg

SEQ ID NO: 1078 - DNA, 495 bp, Nicotiana tabacum
gacgtttttcaagcacaaaatgttcagagcaaaggccttcctttaaaattcttaatggtgaattcaagttcagggctagtaattgacgaaaatgaagacataaatatcaaatttgcagcaccaagatacgtgtctatttgcaataaaaccactgtttggaaaattgaagatgggtttgtgaccactggcggaattaagggtgggtctgaaaatggcacggccacaagtttgtttactattcagaagtatgaagatgcctatgcgttacagtattgtccaagagctacagggtgttcttttatttgtccaagattgttgtgtgggtatattggtattgcaccagcgaataatggatcgaggcgtttggctgtcaatcgtccggttttcaagattttattccaaaaggcttagcatacagagggcggactcaagatttttcttaattaaatatttataacagatgtgaacttatatgagcaaaagctattagaatta

SEQ ID NO: 1079 - DNA, 307 bp, Nicotiana tabacum
ttttggacgaaatacctattttaaagcaaatgggaaatcacaggaccagaaacagtcagaactatgtcaacataaatgatttaaaaagttgcagcaggacaaaaggaagggaaaaaacaatgatccagaacatgcgagggagtacttgtacaccagcagcagttaataaaattctacagcctcaaacatgtcagtaggggcatactcttgtttcaactgaccattggatcaggacttgatgcagacacaacatccagcagtgagttcacaggctctaattcttcatgccaaagttggagggaatcac

SEQ ID NO: 1080 - DNA, 406 bp, Nicotiana tabacum
taaagctcttactaatgaaccgttaaaattgcttttcttgtagacattacaaacacacttctctctttaaatagaaagtttattacaatggcagagtaatattcttacaaaatagaattcatccatctctttcaggttagtgaaactgaaaccttcaattctaatgatggaaatcatatctccttgcgacattattcgatcaaccaaggttcttgaactggtgtccatgagcacagttcaccttctccaaaccaaagcgctatttcacgcttgccattgtcagggctatcacttccatgcaccgcatttcttccagtttgaacagcaaggtctcctctgattgtgccgggctccgcgttaagtggattagttgctcctatgagcttacgggcagctcctccgccca

SEQ ID NO: 1081 - DNA, 533 bp, Nicotiana tabacum
gcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcag

SEQ ID NO: 1082 - DNA, 226 bp, Nicotiana tabacum
gtggataaccctcccccagcctagaccaccaaaaagtaggtttacaagctgttgatactggtgggaagaaaatctatggatcaaaaggtgtgtcaagtgcaaccaaagaaggttcactgtcttcaaactgtgttaaaagaagccatcaggggaccccaaatagtagaagctcgaatggtactaccaattctcctgatgatgaaaatgggcatgaactggtgggcta

SEQ ID NO: 1083 - DNA, 426 bp, Nicotiana tabacum
  modified_base (45)..(45): a, c, g or t
ttttaggcattaaaaaatttattatataaaatatgaaatgtatanctcaaagaaaaatacgcatatgttgatgaaaagaaaagtagctacttttgttgtgttcggaaacggagagatcctgaaggagtctttccacaaatatgaatgccaaaaaactatagcgtacttacaccctgtattgaatattgaatcagttgaacaaaataaaagtagtagtagtagtagtaaagtccagccgcccaaacacgtggttcgttatgctgatttttaatctgccgcagggaaaaggggacaaaatataaagttttcacttcaccttccatccctccctccccgatgcacacaatgaataaaagaaaaaaactaccgcactctactatgactacatgctgcacttataccccgcccggaatcagttaaacaaaa

SEQ ID NO: 1084 - DNA, 312 bp, Nicotiana tabacum
agtaacaaataagagtctaaacagtagtgcttgattttatctcatgcactcatgtgagttttcttcacgttgtatgtttgaagttgtgtaagggcagtgtgctgactctgtgtatataggcggccatgcccgcttctgtgtattaagaagaaagtgagtttactactccatatcaggacgcaggactgcttctatgcgtggaaagcgatggtgtgcatatgtatcttgttaaggtgttgtatgtggtgtcccatgtgtaatgctgtactctttggatctaatatatgagtttaagtattgtgttatacaaaa

SEQ ID NO: 1085 - DNA, 371 bp, Nicotiana tabacum
caaagaaaaatacgcatagttgatgaaaagagaagtagctacttttgttgtgttcggaaacggagagatcctgaaggagtctttccacaaatatgaatgccaaaaaactatagcgtacttacaccctgtattgaatattgaatcagttgaacaaaataaaagtagtagtagtagtaaagtccagccgcccaaacacgtggttcgttatgctgattttaatctgccgcagggaaaggggacaaaatataaagtttcacttcaccttccatccctccctccccgatgcacacaatgaataaaagaaaaaaactaccgcactctactatgactacatgctgcacttataccccgcccggaatcagttaaacaaa

SEQ ID NO: 1086 - DNA, 349 bp, Nicotiana tabacum
gatatttcaagccggagacggtttggcaacgaaatgggcggacaagctggtgctcagcatgtgcagccaatgccagttgaaaatccaagtaaaagagtttactgttctgtggtggagtgaagcccaggggttggtagctattgtgcttcaagcaatcaatgagtatagtcattactgttgccgatggcaatgacgtatcaggaaatagacacacaataaacgagaacagaatggggaaaggaattatactggcatttaagctggcagcttgattttgttgggatatgaattttgttttgtcagggataagtattttcttttccttttatgttatgttgttcctccaaaa

SEQ ID NO: 1087 - DNA, 193 bp, Nicotiana tabacum
agtaggtgcatgagcgtaagatggagaaagctcgaaagcaaaacgctgtaggatcattgctaaggcaatcttagtttccaacattgcaaaattattaccaatgcaaatacgaggaccccaactgaaaggcaagaaacaaagtctgttctttgttgctgttgcaattccctcagcaaacctctccggcttgaaa

SEQ ID NO: 1088 - DNA, 327 bp, Nicotiana tabacum
ttcaagccggaaaggttcgcccaggaagacaaggagaagagagatgccatagacacaaagaaccaggccgattctgttgtctaccagacagagaagcagctgaaggaacttggagacaaagtaccagggccggtgaaagagaaagttgaggctaaacttggagagcttaaagaagcgatctcagggggctcaactcaaaccatgaaggatgcgatggcttctcttaaccaagaagtaatgcagcttggtcagtcactctacaaccagcctggtgctggagctgcaccaggtgctggtccggcacctggcgattccgctggtccttca

SEQ ID NO: 1089 - DNA, 453 bp, Nicotiana tabacum
aaatcatatcaaacaacgctaaaatcatgaatcggcctccaatccaagcttaatgaactctaaaatttcaaaccttctactttcggtgcttaaacctatcaaatcacgtccgattgacctcaaatttttcatacaagccatatttgacattgcggacctagttcaacttccggaatcgaaattcgaccccgatatcaaaaagtccactaccagtcaaacttctcaaaaaccttcaaatttctatatttagctaaatgactccaaaatgacctacggatctccgaattcacttccggtcgcactcccaatcccagaatcaccatacggagctattcccagactcggaatcctgaacggacattgataacactgaaatgcacttcaacccaaacttatgagattcttccaaaatgctaactttcacaataggcgccgaaccgctccggcttgaaa

SEQ ID NO: 1090 - DNA, 341 bp, Nicotiana tabacum
tacaacaacagtacaaacccagtgagatcccctactttagtgaagatagagacacctcggctcaagaaaggaaaccacgccaattttgtcgtggaatacaaacagcctccaaaggtttatctttgttcaaagtgattctagaattatagcacgcgtccaacttttcttcttccacacttttccaatcgaacgactgaatcagggaacccaataccagtgaaacagtgcgcaagcccatagcagctccagggcatgctcttctccccattccaaatggtactaatttatagttgaatccttctttttctccttccatggcctcaaaccgctccggcttgaaa

SEQ ID NO: 1091 - DNA, 241 bp, Nicotiana tabacum
ctctaatgttattatttctgaagatataactgcattatgacatacatacatacatacttttgtgttcactactaaaatcactttcaagcaaaataaaagatacaagatttaagttggataagtagacgataccattacaaaagatttaaagcacgagttcaaacataacaaagagtctatcttgatggaaccacagaagtgctgaatcaaacagagtaaagtttaggtgaaagtcttggct

SEQ ID NO: 1092 - DNA, 122 bp, Nicotiana tabacum
atagcatgtaactagaatattgaaattgataggtgtacgctgcaacactgaaaggtatattgatgactatatatataaaacatcaggtcaaattaatatgctgtcaaactagtagaggaact

SEQ ID NO: 1093 - DNA, 173 bp, Nicotiana tabacum
gaggttgtttggagttaatcgaagtgcaagtttcgttcgccgattcaaggtttgtttgcgattcgggtcgatttatgtggcgatttcacgatttggagttggccgttgaatctacactcatttgtttcttctgattctgttaaaagttattcgtacatcaacaggtctgttaa

SEQ ID NO: 1094 - DNA, 181 bp, Nicotiana tabacum
  modified_base (5)..(5): a, c, g or t
  modified_base (9)..(10): a, c, g or t
gactngcannggccgccatggctgccgcgggaatcgattacacacaagtatttatgtatgtatgttataatgcagttatattttcagaaataataacatacatacataaatacttgtgtgttcactattaaaaccactttcaagcaaagaaaaagatacaagatttaagttggataagtag

SEQ ID NO: 1095 - DNA, 264 bp, Nicotiana tabacum
ggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatt

SEQ ID NO: 1096 - DNA, 243 bp, Nicotiana tabacum
ggcaatgttaaggctaagattcaggacaaggaaggcattccaccggaccagcagcggttgattttcgcaggtaagcagcttgaggatggccgaacactagctgactacaacatccagaaggagtccaccctccatcttgtccttcgcctccgtggtggtgcaaagaagcgtaagaagaagacttacactaagccaaagaaaatcaagcacaagaagaagaaggttaagctcgccgtcctccag

SEQ ID NO: 1097 - DNA, 189 bp, Nicotiana tabacum
ttcaagccggagcggttccgcactataacaagtagttactatcggggagcacatgggattattattgtttatgatgtaacggaaatggagagcttcaacaatgtcaagcaatggttgaatgaaattgacagatacgcaaatgagagtgtttgcaagcttctggtgggaaacaaatgtgatttggtagaa

SEQ ID NO: 1098 - DNA, 202 bp, Nicotiana tabacum
gtttggcaacgaaatgggcggacaagctggtgctcagcatgtgcagccaatgccagttgaaaatccaagtaaaagagtttactgttctgtggtggagtgaagcccaggggttggtagctattgtgcttcaagcaatcaatgagtatagtcattactgttgccgatggcaatgacgtatcaggaaatagacacacaataaacg

SEQ ID NO: 1099 - DNA, 466 bp, Nicotiana tabacum
ttcaagccggaaaggttccaaagttataattcaatccaaattctttttaccccaaatcctgttcaagtccttccgatcgttcaaaataggaggatacagttagttggatccgatacaacaaaatgagagaaatgaaatgagagagtcttattggtgaaaacccacacaggcaccgtgaggcgacagtaagcagagaaactagaaatgagagagtcttgttagtgaaaactcacaaagagcactataagacgatagtgagaagagaaatgggagtggtcagctagtaaaaacccgcaaagggcgcccctgatcgaaaagaagatcctcacagccatcggcatcgacagagtcttggcaaggtctctcgattttgaggcaaaagttgtggtgaatttctaagagtcaaatggtttacacaggatcagacatccagtccaaaaggcatgtcaagttcattgaagtccaa

SEQ ID NO: 1100 - DNA, 459 bp, Nicotiana tabacum
ttcaagccggagcggttcggactccgctagagcggtggtggagaggtcgctgaagctgttggaaacggtggcgacgtgtacggaaggcagggcggcgatagggaagggcgaggagtgcttgacggcaatagttacgagactcatgaagagctcgagagctgcgacggagcacggcgtgacggtgctgtggagcgtatgttgtttggcgcgtgatacggcggcgcgtgaggttatagggagggtcaatgggctgaccaaggtgttgctggtgatgcagagtgattgctccaccggcgcacggcagatgtgtggggaattggtcaaagcattgcgagtggtgaataataataatagtaagaattattcaaagtcgtgtttggcgagttatgataccaagactactcacatcatgccctactgaaaatatttattaaattaaatgccactcctaattgtata

SEQ ID NO: 1101 - DNA, 432 bp, Nicotiana tabacum
ttccgcactataacaagtagttactatcggggagcacatgggattattattgtttatgatgtaacggaaatggagagcttcaacaatgtcaagcaatggttgaatgaaattgacagatacgcaaatgagagtgtttgcaagcttctggtgggaaacaaatgtgatttggtagaaaacaaggttgtggacacacagacgggaaaggctctggcagatgagctaggtatccctttccttgagacgagtgcaaaagactccattaacgtggagcaggctttcttaacgatggcgggagagatcaagaaaaaaatgggtaatcaaccagctggagccaagaagacaggtagtactgttcaaatcaaaggacaaccaattgagcagaagagcaactgctgtggctaactgctgacgctgtgcttctgtatccctcta

SEQ ID NO: 1102 - DNA, 570 bp, Nicotiana tabacum
gttccgaacaattacaacagcttactaccgtggagccatgggtatcttgctggtatatgatgtgactgacgagtcatcgtttaacaacatcaggaattggatacgaaacattgaacaacatgcttctgacaatgtcaataaaatactcgtgggaaacaaggcagatatggatgaaagcaaacgggctgttcctacatccaagggtcaagcgctagccgatgaatatggcattaaattctttgagacgagtgccaagacgaatatgaatgttgaggaggttttcttttcaatagctcgggatataaaacaaagacttgctgaatctgacaatagagccgagcctcagaccatcaggattaatcaacccgaccagggagcaggaggtgctcaaactgcccaaaaatcagcttgttgtggttcttaagaaattggcagtaacgaagataggatgatgagggaggaggaattaatcttttccatgacgttaatgtttcttcacaatctatttactttctcgaagctcctactatgtctaaaattataatctaagtcttgcttattatttatatc

SEQ ID NO: 1103 - DNA, 263 bp, Nicotiana tabacum
atcaaaaggctcaattgacagcacatatgcttagacatcattgcatacactccctgagaaagatcacatgattgtccctctcaagttccatcctctaatctcacagtaaagacggttgtaaaagcagctatatgagagaaatgattatccaaacaccagttgcactaacaaacccaacctaacacggaatgcacttcaaattttctaaacaagccatagactttaccctgcccatctaggacccgaaccgttccggcttgaaa

SEQ ID NO: 1104 - DNA, 348 bp, Nicotiana tabacum
gtatattgatgactatatatataaaacatcaggtcaaattaatatgctgtcaaactagtagaggaactgaattcctcggatagcatattctcacaggactacagcctgtgcattattaggggagcaccatatttgggtttcaaagtgaccacagtgtatggagagtgtgtataagatggagagagctcgaaggagaagcgttgtagaatcatagctatagccatttttgcttccaaaatcgcgaagttttgcccaatgcattttcgcggtcctgcaccaaatggaaaatatgtcattttcccctttgttgcctttgccaccccttcgctaaacctctccggcttgaaa

SEQ ID NO: 1105 - DNA, 245 bp, Nicotiana tabacum
agaacagatgtgacaagtgcaattctgctggatgtgcaaaggatgagaacgcagagataggaatatttacaggactaaagaaccataaaaactctaaaatatttcagatcaatgctggttcgaaaagaatttagaaaggaaatctttgggtttcggttcctgggtgtctttccagcgcatcatcatgtgacccttttgctggtagtaagctgcagtttccttcaactccatcatgaagtgtgaca

SEQ ID NO: 1106 - DNA, 391 bp, Nicotiana tabacum
tccgaacaattacaactgcttactaccgtggagccatgggtatattgctggtgtatgacgtaactgatgagtcatcttttaacaacatcaggaactggataagaaacattgagcagcatgcttccgacaacgtcaacaaaattctggtcggcaacaaggctgacatggatgaaagcaaaagggctgttcctacatcaaaaggtcaagcactagctgacgaatatggcattaaattctttgagacaagtgccaagacaaatatgaatgtggaggaggttttcttttccatagctcgggatataaagcaaagacttgctgaatctgactcaaaggctgagcctcagactatcaggattaatcaaccagaccaggcagcaggagcttctcaaag

SEQ ID NO: 1107 - DNA, 346 bp, Nicotiana tabacum
attccattttgtcctattcagcaatgccatttaggctaaattttcaattgacagcaagacaagggacaaaagatgagaagtttctggattagggggaatgagggagagagaagacacaaaggctacttacaatagttctgaaaacttaactagtttctaaaggaaataaagaaaaagattaatagatgaggcaagggggaaagaagaagaaaaggcaaggataaaaaggaaacaccatatatatgcagagaatatgtaaagatcaaagagcacaagttggaggattcacaagggattgtgacatacagcaactgacattacttcaactccatcatgaagtgtgaca

SEQ ID NO: 1108 - DNA, 327 bp, Nicotiana tabacum
cgatgaagagatcgaactagttgtcaaaactactgaaatagctggagttgtcagtgagggataaataacttttctcgcttgttttggactttctggaattgctcgaacaaaactagagtgagtttccaagcttttttgtccattggcgatttcctcttcgagaatatcgtctccttcttgtccactctcactgatatcttcagactgacggagtcttaaaggagagctgttgacaggtttcctttcatttggaggtagatttaattcttggttattattaggtatctgggggtaactaaaaggtttgggaaccgctccggcttaaaa

SEQ ID NO: 1109 - DNA, 424 bp, Nicotiana tabacum
gttcgcccaggaagacaaggagaagagagatgccatagacacaaagaaccaggccgattctgttgtctaccagacagagaagcagctgaaggaacttggagacaaagtaccagggccggtgaaagagaaagttgaggctaaacttggagagcttaaagaagcgatctcagggggctcaactcaaaccatgaaggatgcgatggcttctcttaaccaagaagtaatgcagcttggtcagtcactctacaaccagcctggtgctggagctgcaccaggtgctggtccggcacctggcgattccgctggtccttcagaatcatcatcagggaaaggacctgatggagacgtaatcgatgctgatttcaccgacggcaagtgagcatagaagagcaattttgaggctatatttacttttcagcttata

SEQ ID NO: 1110 - DNA, 461 bp, Nicotiana tabacum
gttccgcactataacaagcagttattatcggggaagcacatgggatcattattgtttacgatgtaactgaaatggagagcttcaacaatgtcaagcaatggctgaatgaaattgacagatatgcaaatgagagtgtttgcaagcttctggtgggaaacaaatgcgatttggtagaaaacaaggttgtggacacacagacgggaaaggctttggcagatgagctaggtatccctttccttgagacgagtgcaaaagaccccattaacgtggagcaggctttcttaacaatggcgggagagatcaagaaaaaaatgggtaatcaaccagctggagcgaagaagtcgggtagcactgttcaaatcaaaggacaaccaattgagcagaagagcaactgttgtggctaactgctgacactctgtttctgtatcgctctgttcccaattgcaaaatgtgaacagcta

SEQ ID NO: 1111 - DNA, 329 bp, Nicotiana tabacum
gtttggcaacgaaatgggcggacaagctggtgctcagcatgtgcagccaatgccagttgaaaatccaagtaaaagagtttactgttctgtggtggagtgaagcccaggggttggtagctattgtgcttcaagcaatcaatgagtatagtcattactgttgccgatggcaatgacgtatcaggaaatagacacacaataaacgagaacagaatggggaaaggaattatactggcatttaagctggcagcttgattttgttgggatatgaattttgttttgtcagggataagtattttcttttccttttatgttatgttgttcctccaaaa

SEQ ID NO: 1112 - DNA, 435 bp, Nicotiana tabacum
gtgtgcaagtggaatcatggaagctattgccatttggaatgggaaggagagcgtgtccaggttctggacttgctcaacgtgtggttggtttagctttagcatctctagtgcagtgttttgagtggaaaagggtaagtgaagaggtggttgatttgactgaaggaaaaggtctcaccatgccaaaagctgagccactcatggctaggtgcgaagctcgtgatattcttcacaaagttgtttcagaaatatcctaacgtttcagagtgtttcttgcatttttttagtgctccatacctctagtttttaggttagaaaggtttgagtaataaagcaccatgtgtcttcattctctcatataatatgtgctatgtaagtttctgatttgttacttagatactttggattaaatatatgaggtgctacttctttttaaaa

SEQ ID NO: 1113 - DNA, 301 bp, Nicotiana tabacum
gttctactaggaaataaagtgaaatgtgcagatggcaaggcttgtacacggaattgcgatccagatgtagcttacatggtttgcccatctactcgacaaaagattactaaaccatgtgtcaactgttgctcagcaaaaaaaggttgcaagcttttccgcagcaatggatctgtaaaatgtactggaacttagcttttgtccattattaataagctagctacaaggccactacttaggatatctgtgcaataaggcttgacaatatataagttctcacgtgtgatttgtactatatattgag

SEQ ID NO: 1114 - DNA, 123 bp, Nicotiana tabacum
aaaagaatttagaaaggaaatctttgggtttcggttcctgggtgtctttccagcgcatcatcatgtgacccttttgctggtagtaagctgcagtttccttcaactccatcatgaagtgtgaca

SEQ ID NO: 1115 - DNA, 223 bp, Nicotiana tabacum
  modified_base (38)..(38): a, c, g or t
ttttaggcagaaagcgaaattctaccattcaaacatanaaatcacaacaaaattaatatgtacacataattatgatcctccttaacccaaaacaacatgaaaaaacacattttttttgtttcattttcttttcactagatcaatttactactactacataattactaaaacgatggaacgacgccgtatgaagcgtcggaggagccatggtggcgtctagaga

SEQ ID NO: 1116 - DNA, 325 bp, Nicotiana tabacum
aggtcatcaccattggcaatgggaaggtaaacctggcagattccaatgtccgtccagttgaggtattcatgtgcagcatagtccgcaaaatgggatatggagaaggcttcagatggatgtctcagtatatcaagtaatgggtctaggaagtgacattttgtaattctgttttaatttatacttttgtaccggataaattgaagatgtttgtttatcactatgggctatagtttctcttgttctaggtttctagtgaaaacagtaaaagaagtattctctactatattgtctagtcttcaattgttatagaaatataatgatggta

SEQ ID NO: 1117 - DNA, 359 bp, Nicotiana tabacum
  modified_base (181)..(181): a, c, g or t
  modified_base (247)..(247): a, c, g or t
  modified_base (252)..(252): a, c, g or t
  modified_base (296)..(297): a, c, g or t
  modified_base (310)..(310): a, c, g or t
  modified_base (351)..(352): a, c, g or t
gtcacacttcatgatggagttgaaggtatctgctaagcggacaaatgttcctggtttgaagcaatttcgaggaaggcgattcaacccttatgcaggatttcgccctcggcgtccattcatgcctggtgctccagtctttccaccttttggaaggattccaaggttcagacgccccacccgnctacaggccatactagtggattttagtccggattgcatggccttcccgaggaaagcattggggctncccgntagggagagacgtgtctccttgttactcctctttggtttccttnnggggagtgcaaangatgttatagttcaaattttcctgtaccatttaagttaaannggctgaa

SEQ ID NO: 1118 - DNA, 249 bp, Nicotiana tabacum
taaagaacagatgtgacaagtgcaattctgctggatgtgcaaaggatgagaacgcagagataggaatatttacaggactaaagaaccataaaaactctaaaatatttcagatcaatgctggttcgaaaagaattagaaaggaaatctttgggtttcggttccctgggtgtctttccagcgccatcatcatgtgaccccttttgctggtagttaagctgcagttcttcaactccatcatgaagtgtgaca

SEQ ID NO: 1119 - DNA, 425 bp, Nicotiana tabacum
ctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcataatgaatcggccaacgcgcggggagaggcggtttgcgtatgggcgctcttccgcttcctcgctcactgactcgctgcgctcggtcgttcggctgcggcgagcggtatcagctcactcaaaggcggtaatacggttatccacagaatcaggggataacgcag

SEQ ID NO: 1120 - DNA, 346 bp, Nicotiana tabacum
tttaattgaacaaggaatgaaataccatactcaatatatagtacaaatcacacgtgagaacttatatattgtcaagccttattgcacagatatcctaagtagtggccttgtagctagcttattaataatggacaaaagctaagttccagtacattttacagatccattgctgcggaaaagcttgcaacctttttttgctgagcaacagttgacacatggtttagtaatcttttgtcgagtagatgggcaaaccatgtaagctacatctggatcgcaattcccgtgtacaagccttgccatctgcacatttcactttatttcctagtagaaccgctccggcttgaaa

SEQ ID NO: 1121 - DNA, 200 bp, Nicotiana tabacum
accaaaaaatgacatatctttcttagtcatccttcccccaatggaatgagcacaacaaggtactaataccaccattagaaggaaaaaaaactaaggaagatgtgccaaaatacaagttacatattattctatgtattatctctaacaaatctcataaatccttcaaggttcggaggaggccatggtggcgtctagaggca

SEQ ID NO: 1122 - DNA, 346 bp, Nicotiana tabacum; identical to SEQ ID NO: 1107

SEQ ID NO: 1123 - DNA, 213 bp, Nicotiana tabacum
gtcgcatgcctacaggaacaggtggtggcggcggcggttatggaggtggccgtcgtgaaggtggttacggtggtggctctgaaggaaactggaggagtcagatttccccgttgcctttagatttattttctttggtttgaaatttatggttcctaagttttggttgaagtacccgttatggtttactgtggttcctgctactgtcctcgtttt

SEQ ID NO: 1124 - DNA, 447 bp, Nicotiana tabacum
ctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttcccagtcgggaaacctgtcgtgcccagcctgcattaatgaaatcggccaacgcgcgggggagaggcggtttgcgtattggggcgctctttccgcttcctcgcctcactgactcgctgcgctcggtcgttcggctgcgcgagcggtatcagctcactcaaaggcgtaatacggttatccacagaatcagggataacgcaggaaagaacatgtgag

SEQ ID NO: 1125 - DNA, 436 bp, Nicotiana tabacum
gatcatttgatcaagttacatgtattcacactcattaacgtaaaaaaaataaatggaaagaacaaatacattggaccccattcttgcaattggtcctattacatccatggtccaatgggaccaatttgaggatcagaattaaataaaaggtgcaattagttcatgaaaaagatgggaatcgagtgcacctctgtgaaaggaacactttacaatcatcctttggagcaatggttggaatatacgcgatatcatcacagccgtccgttttgtgcctcttgaaatcaatcagagccgtgaacaacgcaataaagagcatcaaatggtttatagcatacctctgtcccacacatccatggggcccagctccaaatgctagataattcttcttgtaaacccgttcctcttgcctctcctctgtgaaccgttccggctcaaa

SEQ ID NO: 1126 - DNA, 561 bp, Nicotiana tabacum
gctgaaattttattattagtttcaacaactattacattcagcttgaaaaggcccttagtaaggtaacctttttcctacaaacatttcattcttactaatcactaccttgtcagatacaaaaacgcacttgaaaccatgctttacaagaagtccagtaaagactaagttcttcctaatctcgggaacatgaaggacgttgttcaaagtcatgaccttgccagaagtcatcttgagaaatatcttaccgtatccttcaatgtttgttgtagcagcatttcccatagagagcttctcttcgggtccagcagaagcatatatagaaaatacttccctcacggcacaaacatggtgagtggctccagaatcaatccaccactcctttgggtttcctaccaggttgcattcagaaagcatggcgcacaagtcatcaacatcatcatgcttttctaccatgtttgcttgacccatttgcttgtctttcttccgagcacaacacttcgtagattgtgtccggttttcccacagttgtagcagtttccactgaaccgctccggctcgaaa

SEQ ID NO: 1127 - DNA, 351 bp, Nicotiana tabacum
agttcgagatgctgctagggaggctgctcttcgtgaaatcaaggaaagaatcaagaagacaaaggatgaaaagaaggctaagaaagcagaggtgatggcaaagtcacagaaaggtggagggaaaggtaatgtgtcaaagggagctgcaggaaaaggccccaagcttggtggcggcggtggaaaacgttaagctattgtttatgtttgtgtttctaagtagtactagaatggttttgcatcttgattgaatgtaagtttttgatccaactgcagatcagcagttcaaacaaatatatttctgaattttggtcttgtttcaaatatgcagattaattactcttgttcccaaaa

SEQ ID NO: 1128 - DNA, 435 bp, Nicotiana tabacum
tccaaagttataattcaatccaaattctttttaccccaaatcctgttcaagtccttccgatcgttcaaaataggaggatacagttagttggatccgatacaacaaaatgagagaaatgaaatgagagagtcttattggtgaaaacccacacaggcaccgtgaggcgacagtaagcagagaaactagaaatgagagagtcttgttagtgaaaactcacaaagagcactataagacgatagtgagaagagaaatgggagtggtcagctagtaaaaacccgcaaagggcgcccctgatcgaaaagaagatcctcacagccatcggcatcgacagagtcttggcaaggtctctcgattttgaggcaaaagttgtgatgaatttctaagagtcaaatggtttacacagatcagacatccagtccaaaaggcatgtcaaga

SEQ ID NO: 1129 - DNA, 311 bp, Nicotiana tabacum
tccaaagttgtagttcaatccaaactcttgttacccaaaaccctattcaaaggccttcaaatcgatcagtaaagaagttcacaatgggaggttgttggatccaatacaatcaaatgagagaaataaaatgagagagtcttattggtgaaacccacacgggcatcgtaagacgatggtgagatgagaaattgaaaatgagagagtcttgttagtaaaaactcgcaaagagcactataaggccacggtaagaagagaaatgagagaggtcaattggcaaaaacccgtaaagggcgccattgatcgaaaagaag

SEQ ID NO: 1130 - DNA, 529 bp, Nicotiana tabacum
tcctacgattggataggaatgcaattctggaagcaaaacccataaaagggactatagctcgtggttccacccctaaagaagatgaatttctgaaactgcaattagaatacagtgaaaaggatcaggcggaaaatttgatgattgttgacttgttgaggaatgacctcgggcgtgtgtgtgagcctggctctgttcatgtcccacatctcatggaaatcgaatcctatgcaacagttcacaccatggtcagtacgattcgggggaaaaagcgatcagacgtaagtgcaattgattgtgttagagctgcatttcctggcgggtcaatgacaggtgcaccaaagttgagatcgatggaacttcttgatcatcttgaaaattgttccaggggcatctactcgggctgcattggatttttctcttataaccaagcatttgatctcaacattgtgatacggactgttgtcatacacgaagagaagcttcagtaggagcagggggagccattacagctctttcagacccgatgata

SEQ ID NO: 1131 - DNA, 293 bp, Nicotiana tabacum
acgtgagaacttatatattgtcaagccttattgcacagatatcctaagtagtggccttgtagctagcttattaataatggacaaaagctaagttccagtacattttacagatccattgctgcggaaaagcttgcaacctttttttgctgagcaacagttgacacatggtttagtaatcttttgtcgagtagatgggcaaaccatgtaagctacatctggatcgcaattccgtgtacaagccttgccatctgcacatttcactttatttcccagtagaaccgctccggctcaaa

SEQ ID NO: 1132 - DNA, 278 bp, Nicotiana tabacum
atggcataccgccacccctagccttggagtaggacacatagtagaactgggagattatgctggtgaagaaaatgaaagctgctccagctgcaaaaactccttttctcagagtttcacaagatagaggcttgtcgttaatcaagtatgatgatcggtacttggtgtgataagcattcctaactgaaccagccaacaagcagacctcagcaatgaagaatgtaacccagcatatgatgaacaagagaacagcacaagcccttgaacctctccggctcgaa

SEQ ID NO: 1133 - DNA, 322 bp, Nicotiana tabacum
acggttcaagcacttcagtattcagtagatatttgaggaggagcagtagaacttgggtaccggaagagagtaatggagtaaccagatggtaattattttggaaaaaaatgaaaaatatatcaattttcaattattatttactgagcaaaagcactaagaaaacagaaaaatcgtcatagagcagtcgattagaggtcgaacacaacttatcgagaaatatggcataattatctcgaggattatctatcgagtttcaaacagttggcgagacgattttcggtgataagagaattattgtataatttttctaatttatcttgga

SEQ ID NO: 1134 - DNA, 403 bp, Nicotiana tabacum
tctatagcacttacagttattcagtacatatccgaggaggagcagtagcaacttgggtaccggaagagagtaatggagtaaccagatggtaattattctcggaaaaaaatgaaaaatatatcaattttcaattattatctactgagcaaaagcactaagaaaacagaaaaatcgtcatagagcagtcgatcagaggtccgaacacaacttatcgagaaatatggcataatttctcgaggattatctatcgagtttcaaacagttggcgagacgatcttcccggtgataagagaattattgtataatttttctaatatatcttgggtacatttatgtgacaatgaaatgtacaaagttggccattttggaggaaatctgtataatagagaacgctttcgatctg

SEQ ID NO: 1135 - DNA, 82 bp, Nicotiana tabacum
ttgcaaaaatggccatagagttgttaggctactcgcaaataaatgagcaattagctctacaagaagcagcttcagccggttt

SEQ ID NO: 1136 - DNA, 361 bp, Nicotiana tabacum
acggttcaagcacttcagtattcagtagatatttgaggaggagcagtagaacccgggtaccggaagagagtaatggagtaaccatgatggtaattattttggaaaaaaatgaaaaatatatcaattttcaatcattatttactgagcaaaagcactaagaaaacagaaaaatcgtcatagagcagtcgattagaggtcgaacacaacttatcgagaaatatggcataatttctcgaggattatctatcgagtttcaaacagttggcgagacgattttacggtgataagagaattattgtataattttcctaatatatcttgggttcattttagtgacaatgaaatgtagaaagttggccaa

SEQ ID NO: 1137 - DNA, 290 bp, Nicotiana tabacum
ccaaaagaactgatgtgaaaaaactgaaattatctgacctgcgaaggtgagcaaagtaaaccagatgcatctgctcctacaactgcaagatcgcaaacagtacaaagctgtccttgctgtgctggaacaaaatcagtagcacaataagggcaagtgacatccttctggcctctgtatatggggacatatgttgcgccacagaccacaaacggatttctgaagtcataattcaactgtgtagcatctcgcatatttttctcagcttgttgcagaacctctccggctcgaaa

SEQ ID NO: 1138 - DNA, 198 bp, Nicotiana tabacum
tcttaatggagggatcagataaagaaggtttcgatataacaggaagtagagagatcaagatgatgccatttggcgctggtaggagaatatgcccaggctatgctttggctatgcttcatttagagtactttgtggctaatttggtttggcattttcgatgggaggctgtggagggagatgatgttgatctttcagaaa

SEQ ID NO: 1139 - DNA, 216 bp, Nicotiana tabacum
tcgggatgccgctaataaccaacgaatggcaagtcgttgataattttgtcagcagccaattgttctcgaatggggccattcaaggatgtaaagtatcacggaacttcttagaaaagctgcgaagacgggactagtttcaagcagaatccgaataaagaaaaaggcagggtcggagcagacgtcagtaagtgaaagatgcctccaggaggaatccta

SEQ ID NO: 1140 - DNA, 431 bp, Nicotiana tabacum
tggtgtaatatcagtgacattattgtgaacttatcaaaaatgtccaatgatagtgaaaagaagaaatacaaaataatcatgcatttttctttacatagtagctcggatagccagggtagaaggaaatccttaccagtatccagaacccaaaaatcccctaaccttctactgccagatctcccaccaaagatgaacatatgacagtcaattgatacagcaacgtggaatgctcgtgggctgggacccacttggccatcagaaccactgcctgtgcactctggctgaaaccacaatttgttttcaatgtcatagacagtgatgtcattaaggaacttcttgtcaagtagtcctccgaacaccacaactttcgatttcccaatgttcactgcagtgtgtccacttcgaggttgtggaaccgttccggctcgaaa

SEQ ID NO: 1141 - DNA, 332 bp, Nicotiana tabacum
gaagtaaggtctctctcctataaggctggggggatccttcgacacagcagatatgataagactctctcagatcaaaaggctcaattgacagcacatatgcttagacatcattgcatacactccctgagaaagatcacatgattgtccctctcaagttccatcctctaatctcacagtaaagacggttgtaaaagcagctatatgagagaaatgattatccaaacaccagttgcactaacaaacccaacctaacacggaatgcacttcaaattttctaaacaagccatagactttaccctgcccatctaggacccgaaccgttccggctcaaa

SEQ ID NO: 1142 - DNA, 368 bp, Nicotiana tabacum
ttacttgatcaacacaataatactttcagcttcaactgaaacgtttatctttctatatgaaactaaatatccagtgacaatcaacttagggccgcaacagattatatacactccagccctgctgcgtgcccaaagaaaagaagatgcacaacttggatccatgcaagttttggttcatatcaaaatgatggaagtcaccaatccatctccataccatgccatgtggtcatctcaaagggacaaccgataggctcatgcactaactatctatgtatgaattgggagagcacatgcaagagaagcatgatttccctccttgtatacaagatttccgcgcacaaaggttgccaaacctttccggctcgaaa

SEQ ID NO: 1143 - DNA, 295 bp, Nicotiana tabacum
tcgagatgctgctagggaggctgctctccgtgaaatcaaggaaaggatcaagaagacaaaggatgagaagaaggccaagaaggcagaggtgcaggccaagtcacagaaagctggagggaagggcaacatgcccaagggagctggagggaaaggtcctaagctcggtggtggcggtggaaaacgttaagctatattctgttgtttccttgtaagtcagtgtttgagagatttttttgaaggcactgtaagcggcatcatttaccagtagtatagtcaaaaccgcaggcagcaatta

SEQ ID NO: 1144 - DNA, 411 bp, Nicotiana tabacum
tccagaagcagctgtggtcaagtttatgtatggcagagaggagattttgctattctactttaagtagtttgatctttgcagttgaatggattataaggccattatccagctttcgatttgcttaagaatatcatgatccgttgaagatctttagctttaaacaattatgaaagaaaagtctaggggtgtcgatgttacaaagacaagcttgacgggacggtagatgaaaaaaaacatggcaaggaatatcctccttttttggtcattcttttgtttccaaatatgccataacttctgaaaactataactaagaaaaggggactagaaaaagattcgagatcgaatttggttattgatactctcattttgttgcctctgttttacttcttgtacacaattttttttaagaag

SEQ ID NO: 1145 - DNA, 245 bp, Nicotiana tabacum
agccactctattgctaataaggaaacaaaatgaacagcagcttaacgttttcctccgccaccgccaagcttaggaacttttgatgcacctcctttggggaggttgccctttcctccagctttctgggacttggccgtcacctctgctttcttagccttcttttcatcctttgtcttcttaatcctttccttaatttcacgatagagcagcctccctggcagcatctcgaactcgtggccgttcaa

SEQ ID NO: 1146 - DNA, 469 bp, Nicotiana tabacum
tacttgtgaaacataatgtaacggaataaatagttacaaagtgttgaagtcatttcgatgggagaactccatcaggtccagatgaaagagaattaagtacagcaaaagaccaaacaaattggatactaggaagtctggctaaagctaaccaagttgatattacaattaaaacagcaaaacttgatagctacagcttttaacttacttaataaaatagattatgcttcactggtttatggcaataggctgccttcagacatcttagctaggtctccttaccggctatcagaggactagtaccaacactggaagttgcagagaaaccaactccgatagactctggggtggagcactcacccgatttcttgctgaggccatatggtgcagcgttcatcaccctttccttccgcttctcaagaaaccgagccagagatgcttttctagcctgtggaaccgctccggctcaaaa

SEQ ID NO: 1147 - DNA, 424 bp, Nicotiana tabacum
tcaagtagaagtgaataggtaagaagtagaaagactcatatcaatccatctccataggagacaatatgagcaaaagacagaaatccctaaatcccgcaaaaaagaactcactccggagggattgagggggtattcaaaaaggggagctttaaagggtgtgccaaaggccaaaatgtcacttattatggactagagggagtactgtactaggtttggactacaaaactgaaaacgctactccctccggtcgataataagtgactttttggcctctttattttgatccaaaataagtgtcctttacatgacaagtgagacttgctcagttggtaaaagtacctctacctacgaccgttaggtcctgggtccgagtcacgctggaggggaagtgtggaaacactatagatcctcctaatttgggaga

SEQ ID NO: 1148 - DNA, 319 bp, Nicotiana tabacum
catactcaatatatagtacaaatcacacgtgagaacttatatatgtgtcaagccttattgcacagatatcctaagtagtggccttgtagctagcttattaataatggacaaaagctaagttccagtacattttacagatccattgctgcggaaaagctcgcacacctttttttgctgagcaacagttgacacatggtttagtaatcttttgtcgagtagatgggcaaaccatgtaagctacatctggatcgcaattccgtgtacaagccttgccatctgcacatttcactttatttcccagtagaaccgctccggctca

SEQ ID NO: 1149 - DNA, 431 bp, Nicotiana tabacum
tcgagatgccgccagggaggctgctcttcgtgaaattaaggaaaggattaagaagacaaaggatgaaaagaaggctaagaaagcagaggtgacggccaagtcccagaaagctggaggaaagggcaacctccccaaaggaggtgcatcaaaagttcctaagcttggcggtggcggaggaaaacgttaagctgctgttcattttgtttccttattagcaatagagtggcttgtttgaagacactgtaaacgaccaatcatttacaaaagttacatctgcagacaaaagtttctcgtatacaatttcgcacttagttaaaaatgcagctattgattccccgcagactactgatcaattgtgggtgcatcctctgttacggcgtctttttttccactcaaaccaatatgttttagaaatctgtatttgcttcaaa

SEQ ID NO: 1150 - DNA, 247 bp, Nicotiana tabacum
  modified_base (20)..(20): a, c, g or t
gggccgacgtacgcatgctncccggccgccatggcggccgcgggaatcgatttgaacggccacgagatcgagatgctgccagggaggctgctcttcgtgaaataaggaaaggattaagaagacaaaggatgaaaagaaggctaagaaagcagaggtgatggccaagtcccagaaagctggaggaaagggcaacctccccaaaggaggtgcatcaaaaggtcctaagcttggtggcggcggaggaaaa

SEQ ID NO: 1151 - DNA, 248 bp, Nicotiana tabacum
tcaagcacttcagtattcagtagatatttgaggaggagcagtagaacttgggtaccggaagagagtaatggagtaaccagatggtaattattttggaaaaaaatgaaaaatatatcaattttcaattattatttactgagcaaaagcactaagaaaacagaaaaatcgtcatagagcagtcgattagaggtcgaacacaacttatcgagaaatatggcataatttctcgaggattatctatcgagtta

SEQ ID NO: 1152 - DNA, 168 bp, Nicotiana tabacum
ttgaccagctagaacttgatgatttggtggttcatttacttcttagtctttgctcatcattatgtctttctctaaagcattttatttatattgccattatggttatcatgtttgtagatggatgaagatgagaagtacaataggaagttaggagctggactttacact

SEQ ID NO: 1153 - DNA, 245 bp, Nicotiana tabacum
agtgccttggcaagagcaacgaagcagcggaagtttcactgtgaccagcattactttttactgatccaattttcagaggagtgtctcgattcttgcaaaagaaatctgcttccacatttaattccacttcgtcaactttaggcattccgcatccgtaagtttctagaaatgagacatcagcgggcgaaactccacagtctgagtaaaatttagacaaaaactcttggaaccgttccggctcaaaa

SEQ ID NO: 1154 - DNA, 304 bp, Nicotiana tabacum
tgaacggccacgagttcgagatgctgctagggaggctgctcttcgtgaaatcaaggaaagaatcaagaagacaaaggatgaaaagaaggctaagaaagcagaggtgatggcaaagtcacagaaaggtggagggaaaggtaatgtgtcaaagggagctgcaggaaaaggccccaagcttggtggcggcggtggaaaacgttaagctattgtttatgtttgtgtttctaagtagtactagaatggttttgcatcttgattgaatgtaagtttttgatccaactgcagatcagcagttcaaacaaaa

SEQ ID NO: 1155 - DNA, 211 bp, Nicotiana tabacum
ttaagatattctggccctgatggaagccattactgggccagtcatgaaactcatgttgcaggaagtgatgctgatgatgtttgatcacctcaccatcagataaatagttctatcccaaatgtacattctttaactcaccaccccattgtattggattcttgaattgcttgctcactcagcagcttgttctagactgacctctattatgtaa

SEQ ID NO: 1156 - DNA, 259 bp, Nicotiana tabacum
tcaatcggctatcttggggtaaatgtcaatcgaactcggaggagttctcgcatggaatcattgctggtgggcttgttgatggcaacattgggctttggaatccgaagcctctgatctcaaaaggttctgaggcaattgaaagtgctcttgttggaaatctgtcgaggcacagagggcctgttcgcggattggaatttaatgggtttactccaaatctccttgcatctggagctgatgaaggtgaaatcaatcactagtt

SEQ ID NO: 1157 - DNA, 408 bp, Nicotiana tabacum
  modified_base (318)..(318): a, c, g or t
ggaatataatgtatgttgtgcttatgttgtatggaactaaaaaccttgacaaccatacaaaaaatctcacctatatagcccttcttctttaattcttccaagaactccattaaattaagctattcttgctccctgtgatttgtgggaatcaagtagaggtcatctttgcttgctgcaaaaactctacttgtttcagtagtgcgaaaatcatttgcattaaccttgtcagggagtttccaggtcaaagcaatagagcaactgggctaaaaggatgccctgtgttaactaaaccaaaacgaccattccctggaacaccanttcttccttccctgaaacccgaaaaaggaatgaaaacctggatagttgaatttttcccctgttaaagaattcaaaacaaaaaagttattt

SEQ ID NO: 1158 - DNA, 417 bp, Nicotiana tabacum
catatgggaaagctcccaacgacgttaggatgcatagcttgagtattctatagtgtcacctaaatagcttaggcgtaatcatggtcatagctgtttacctagtgtgaaattgttatcacgctcacaattgccacacaacatacgagccggaagcataaagtgtaaagcctggggtgcctaatgagtgagctaactcacattaattgcgttgcgactcactgcccgcttttcccagtcgggaaaacctgtcgtgccagcctgcattaatgaatcggccaacgcgcggggagaggcggtttgcgtattgggcgctccttccggcttcctcgcctcactgactcgctgcgctcggtcgttcggctgcggcgagcggtatcagctcactcaaaggcggtaatacggttatccacagaatca

SEQ ID NO: 1159 - DNA, 451 bp, Nicotiana tabacum
ctgcaggtcgaccatatgtggaatagctcccaacgcgttggatgcatagcttgagtattctatagtgtcacctaaatagcttggcgtaatcatggtcatagctgtttcctgtgtgaaattgtatccgctcacaattccacacaacatacgagccggaagcataaagtgtaaagcctggggtgcctaatgagtgagctaactcacattaaattgcgttgcgctcactgcccgctttcccagtcgggaaacctgtcgtgccagctgcattaatgaatcggccaacgcgcggggagaggcggtttgcgtattgggcgctcttccgcttcctcgcctcactgactcgctgcgctcggtcgttcggctgcggcgagcggtatcagctcactcaaaggcggtaatacggttatccacagtaatcaggggataacgcaggaaagacatgtgagcaaaa

SEQ ID NO: 1160 - DNA, 563 bp, Nicotiana tabacum
aacaagtgtcaacaatagtctatcacacagttcagtatgttcagtcatactcatcagacgtcggatattttaaagccgaaaattaaactaaagcataagataaaagaggttaaaaactaagacaaaagttacacaagcagatcagtctttccacaaaatgctctctcaggcagaagattcaaggttggttcgtcttcaagagacacaccatatttctttcagtagtagccgaacttatatctcctctggtatcatcacaggaaaatcatcttaatgcttagtgacaatgctccttgcaaaaggactactgaaagaaaaacagccaaagttatcctagaaaaaatgcagcagtccagcagattaatcagaggtcagacgacgcctcttttcataatctacatcacgtgatcttgaccgtgaatcatcttcatgcggtaaccgtgatttggtgtgtctccttgatgatcttcccctgtcccattcatcatcatattcttgctcgcggtcctgctacctatgatgatcaccatatctatctctatcatccctatgacggtcatgct

SEQ ID NO: 1161 - DNA, 537 bp, Nicotiana tabacum
tgcgcaaggcaaagaaaacaccagaaaagtggatgttattttgatttttgtagaattttaacaagtgacaggaagtttcatcacagtatcagccttaaccaggcaaagttagtccaagttgaataaacaaaacaccttcaagttttagtgactatcctcttcttcacagaattttgtgtactctttggaccccatcaaagactctagctcggatggactgctcggcttcactttaatcatccacccgtcttcatatggactcgagttaaccaaaccaggtgtttcagtgagctttgtgttgacctcaacaatctcgcccgagattggacagttaatgtcactggtagctttcacactttcaacagcaccaaaactgcttccttgtgaaacagcagcaccagtttctggtagatccacaaacactacttctccaagatgatcctgagcatgatcagtgattccaactgttgccactgaaccctcatgcttcacccattcatgtgaagatgcatacttcagaccatcaagaacagtaga

SEQ ID NO: 1162 - DNA, 197 bp, Nicotiana tabacum
gcaaagtcaagaagtaccaattagaaaaaaaataataaaaccagcatcacaaatttccaagatgtcttgcgcaccaaactcagcaatatcaaatgtttccgcccccttcttcgtgatgacacccttttcagtgataattccactaatcaaatttgctggagtgacatcaaatgcagggttccaaaccgaaataccat

SEQ ID NO: 1163 - DNA, 213 bp, Nicotiana tabacum
aggccgtatggaatactctagctctgcccttgaaatacatacacatcttctccattggaagaaacacaaataatgctaaccattaaacattaaaatacagtaattcattgagtttctacttctgcctcttatatatctttgccaaaaatgacttcagaactgcttgcacttgctttgcttggttgagcttcaatagagttggtcagttttcca

SEQ ID NO: 1164 - DNA, 258 bp, Nicotiana tabacum
tctccacattaatcactttttctaatcatttaacttcactactatcattaatacagtaacggagtcctatcccaaatactatcgtatcataaggataatactacaaaacttcatctctcttcaaattgaaaagctaaatatttcatttgcttgataaatccctatccatttcatcccagctgattctcgattttgttgcatttcctccgtcaaatttcaaaatatttgtatccgtcatcagagttggtcagttttcca

SEQ ID NO: 1165 - DNA, 459 bp, Nicotiana tabacum
gctagaagaaattacaatcacatacaatcaatgacaaagtagcaaaacaaaatactcacaagatactacctactatgtgaaaagctggctatgctagttttctttaataggtagttttattgccacaaccaaatcatgataattcacaaataagaagtgtttttatttgggagctgcagtttgaaagcgaggttgaaaatgggcaagtaaagcatcccttgaaggtaaatattccttaacttggctgcagttaatatactcatctttccatgcacaaaaattgggaaatttttcatttgtcaccaaaattactccagaggcttcttcaagaattcccagccaaaatcccattaaatttgcagctatatcagcatacccaaagttatctcccacaaagaattttttgtccttgagctcattatcaagaatctttagcagctcaccacattcctctttagc

SEQ ID NO: 1166 - DNA, 447 bp, Nicotiana tabacum
gaaaagctggctatgctagttttctttaataggtagttttattgccacaaccaaatcatgataattcacaaataagaagtgtttttatttgggagctgcagtttgaaagcgaggttgaaaatgggcaagtaaagcatcccttgaaggtaaatattccttaacttggctgcagttaatatactcatctttccatgcacaaaaattgggaaatttttcatttgtcaccaaaattactccagaggcttcttcaagaattcccagccaaaatcccattaaatttgcagctatatcagcatacccaaagttatctcccacaaagaattttttgtccttgagctcattatcaagaatctttagcagctcaccacattcctctttagctttgtctgactcctctccttttccaaataaagctttcccaattgtagttatgcacttaacatcaag

SEQ ID NO: 1167 - DNA, 615 bp, Nicotiana tabacum
ggaccgatagtatgacgttagaggtatatttggacggatagtataacggagggtaatattagacctttttcaatagtataaggacatatttgacccttttccgtttcaagaatccttggttcagcagatcaagaaagcaatacaagtggaagtaccacatatcaacttacaaacataatttatgccataaaccagacacaaacattactatctggatgcagaacaactctatttctttatggtttcttattttcctattcccttttccagaacaagctttctactaaaactctgcaattgccttaaaacagaatgagcacattaacaatattcaatgaacttcctcctccttgtttgtatgaataacacagtcagatctcgggtacgaaatgcaagtcaacaaataacccttctccatttgatcgtcgtcgaggaatgcaccttcggattggtctactggtcccgaaaccaactgtcctgcacaagtacaacaagaaccagccctgcacgagtacggcagctccaaaccagcatcctctgctgcatcaaggatgtattgatcgtcggacacttcaatttcgttctcggtaccatcagggcctattagtttcatct

SEQ ID NO: 1168 - DNA, 407 bp, Nicotiana tabacum
aaagagttctcaatatagggataatacaaggtattctaagcattcttgtagacatacacgtccctcatatataaagtataaacccgagcatttctaggattgtgtttcgacgagtcaccccttgcagcttattaatcaagtacactaatttgagatcaaaaagaagaaagagcaattagtccactaaactctcttcagcgttcaaataaaaaactggaaagtacataaagttgcagcaaagcggagtgcttagtaggtgtagcccttaacaaacattcctttcttagcttcctcactttcacctgctgcagagtattttccaagctgagccaaggagtttgcttttgcacgaatcaagagtgccttttgtgcagcatctacattctcaggacgaccttgccatgtct

SEQ ID NO: 1169 - DNA, 508 bp, Nicotiana tabacum
tatatgacccaagagaggccaatgtttctatagccttgacaaatgtcaagtataacttccattacaacttacagcaccattgaggaggctcatatacatacattttagtaaatcattgtaaaagtcttggacttgagttagacaacatccatgatgttattgtctccacaagcagatccaagtcctttgaattccccgagctaagaagtatagagtctacattaccaagtgtattgccgacttcctttgcaacactttcccatggtgttcctgcagtcaaatttgccaatagctccccgctcctgttaacagcatctgtcattcctgggggaacatctggcagagcctgctgtagaggaagcgcatggtctccaggaagagagcggatggacatatccagcattgagctgatagcagaacctgagctgagcacttgagctagtgttgaagtttcgtcgattgtatcatctttgaactttattaagagattcctcgatatcccgtagta

SEQ ID NO: 1170 - DNA, 479 bp, Nicotiana tabacum
caagcaaagaaaaagataaggacgctctcaaggtccggaagaagagccgctctcacaccaaacgtcgtcgtagccgtcactcatcctccgatagctattcttcttcctcttcctctgaagactacagttcttcggacagtgagcgtgaagcagtcaacagttcaaaaagacacagacagaaagatagagccactaagaaggataaagagagagggaaaagtcacaggcaaaaacgtcataagcataaaagtaaagaggtagatttttgttctcatgaccatgcagtagacttctgctttttatgttttaatgttttacactactgctccgagcatataaaactttaagcatgctgttgtacagtccatataaactttttatatgtcagttgttgggagttactgtgtttattaatgtatgagatgctgatagtacaatcactagtgaattcgcggccgcctgcaggtcgaccatatggg

SEQ ID NO: 1171 - DNA, 180 bp, Nicotiana tabacum
gtcttggtcttgtgctgctagctcatttcaggcgtctttttccccttttcttcaagtggatgcatgcggatgatgacagaactgttctactggttctagaacggatcaaaacagttgtaaagttgacatggataaggaattcgccacacattgaaagattggtggatgagcttgttagtt

SEQ ID NO: 1172 - DNA, 200 bp, Nicotiana tabacum
tcttcggacataggatatgataaagtctaacacttaactaaagcataagataaaagaggttaaaaactatgactcatgttactcaagacagatcaatctttccacaaaatgctctctcagacgaaagatacaaggttggttcgtcttcaagagacgcgccttatttctttcagaagtagccgaacttatatctcctctgg

SEQ ID NO: 1173 - DNA, 455 bp, Nicotiana tabacum
agaacaccgagtgctgaacctcagagtgcccgacaaaatctgggcacaaagaatatgaaaagataatacagatgattaaaagacactagaaggtagcagatcagcaaaaaactgaggattaaatcctaaaacattacatcaaaattacaagttcagttcagtatgttcaagtgatactcatcggacataggatattgtaaaagtctaacacttaactaaagcataagataaaagaggttaaaaactatgacacatgttacacaagcagatcaatctttccacaaaatgctctctcagacgaaagattcaaggttggttcgtcttcaagagacgcgccttatttctttcagaagtagccgaacttatatctcctctggtatcatcacaggagaaatcgtcttaatgattagtgacaatgctccttgcaaaaggaatactgagagaaaaacagccaa

SEQ ID NO: 1174 - DNA, 167 bp, Nicotiana tabacum
tataaggggtttgttgaagtactggcctgtcactaattgccagaaggaagttctctttcttggggaactcgaagaagtgctggaagctacgcaagctgctgaatttcagcgctgcatggttcctctttttcgacagattgctcgttgccttaacagcccgcactttc

SEQ ID NO: 1175 - DNA, 129 bp, Nicotiana tabacum
tgatttctcagccatgactggactgcttaatgatccaagtattaaagaactagctgagcagattgcaaaagatccttcatttaatcagatggctgagcagcttcagaagacctttcaggttgcagcgta

SEQ ID NO: 1176 - DNA, 394 bp, Nicotiana tabacum
gaaataaggactggaataggaataatattgcatgtcaattttgctcactgtagtactcaaccatacaaaggcaaaaattacacctttagaaacactattggagcggaatcggagaaaaagaaaatcagaagggatacccaaagcacttaatttccacaaagccggatgttctagcaggaaattacaatttgcagtataaatattgagaggaataaatggaagacagacctctcaatatctctataaagctggattccagtacttgtttccggttgattgttgtctttcaggttgcagcgtaaagggcgaattctgcagatatccatcacactggcggccgctcgagcatgcatctagagggcccaattcgccctatagtgagtcgtattacaat

SEQ ID NO: 1177 - DNA, 574 bp, Nicotiana tabacum
gcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtatagacgccgggcaagagcaactcggtcgccgcatacactattctcagaatgacttggttgagtactcaccagtcacagaaaagcatct

SEQ ID NO: 1178 - DNA, 223 bp, Nicotiana tabacum
gtgggccgcagcgctgtcacgccacagcgagaagctggataggtaatagagccggtagtttctgaaccgattgcaaatggaaccaaacctgctgaggtgcaagaagcaggccctgctgatgaacccgtagaatattcctttatattccacgggtttcttgttctaccaccaaaccagacatcatcatatgctaaagaaccagttaccaactttgcaacaagaa

SEQ ID NO: 1179 - DNA, 250 bp, Nicotiana tabacum
tgaaacgacctacgtccatttcacgttaatatgtatggattgttctgcttgatatcaagaacttaaataattgctctaaaaggcaacttaaagtcaagtatatagtaatagtactatatttgtaatcctctgaagtggatctataaaaagaccaagtggtcataattaaggggaaaaatatgagttgataatcagcttgatgtatgatctgatattattatgaacacttttgtactcatacgaatcaaaa

SEQ ID NO: 1180 - DNA, 455 bp, Nicotiana tabacum
aacctgaaagtgaccataccattttgaaacatttttcagggtaatcattatgctgtccttcttttcaagtagctgaccaacaacgacgcgctaagactaataacgaaataaacaaatccggcaaacaggatcatctcaacctgcgtaccatcacgctcaccaatggttgaggcggtacggaagaaatcggccagggataacacatacaccagtgaggtatcctggaacagtacgatgccctgagtgagcagcagcggcaccatcgcgcggaacgcctgcggcagaataatcagtttcatcgactgccagtgagtcattcccaacgccagcgcggcgctcgattgaccacgagaaatactttgaataccagcacggataatctctgaatagtaggccgcttcaaacatcgaaaacgccaccatcgccgaaattaaacggatatcattttttggcga

SEQ ID NO: 1181 - DNA, 189 bp, Nicotiana tabacum
ttcatctggaatctgagaggaatcctgaacacctcatggcatcgggttcaagtccgagttggccaagcaaatctttaggctgtgttcatgtgttgggcggatggcttattcagcatcaaatgcaatggttgtgtttgtatcttcctagcttaaaatgaaaatagcatgttttcttgatgtcgtctcaaa

SEQ ID NO: 1182 - DNA, 311 bp, Nicotiana tabacum
aggcagatgatgttcctcttcattggcgaatgaagcaacatgagaaggtactcgaagacggggtgcttgatccagagacaactgtggtttctatattcccatctcccatgcactatgctggtccaaccgaggtgcaatggcacgcaaaggctcggatcaatgcaggtgctaacttttatattgtcggacgagatccagcaggtatgggtcatccactggagaagagagatttgtatgacgccgatcatggcaagaaggtactcagtatggccccgggactagaacggctaaatatcttgcctttcaggttg

SEQ ID NO: 1183 - DNA, 266 bp, Nicotiana tabacum
gcaacctgaaagcaatgcgaatggagtttatccaatctcttcctcccagatgatcggtccatcacttcgcgaaacgcacctttaaccctgcttaaaaacgctaacccatcagatttatcgatcttttcatcgaaaatggcgaaaaacacaaatgcgttttcgattaagaacgtgtacgtcctgttacggacggtgtgggtgaaaaaagtgtgtaaaggtggagtcttttcaaggcattttaaggcaatcgaaccaagatcggcatc

SEQ ID NO: 1184 - DNA, 340 bp, Nicotiana tabacum
tgcaggaattcggcacgaggagaacctacgcttgcacccatttcaggtgccaaaggcaaaaagaaagacggagatgaaaggagtaaggatatgatgaagaagcatcgccgccaagttttatttagtggaatcatcacagcagtaggcataagcttgcataactttcctgaagggatggccgtgttccttggatcaatgaagggacttcgggttggtctaaacttggctcttgctattgctttacacaacataccagagggtgttgctgttgcacttccagtttattttgcgacacaaagtaaatggcaggcattcaaattggcaacactttcaggttgca

SEQ ID NO: 1185 - DNA, 390 bp, Nicotiana tabacum
cctcgtgccgaattcggcacgagggggaagtttatggtgcataggccgtttataaggaaggcgattaataatatattttataggtttatatatgagacggagaggcacagtgggataggtgagcttttggagattttagggagtattataaatggtttcgcgttgccaatgaaagaggaacataagcttttccttgttcgagctctcataccgcttcacaagccgaaaccgattgcgatgtatcatcagcagttgtcgtattgtattgttcagtttgtggagaaggattacaagttggctgatacagttataaggggtttgttgaagtactggcctgtcactaattgccaaaaggaagttctctttcttggggaactcgaagaagtgctg

SEQ ID NO: 1186 - DNA, 474 bp, Nicotiana tabacum
gcacaggttcaaacgtatgaattgcaaggatctaaagtcctgcacatgattttactcactccgaaatcggcgatttttacttccatctcgcgatttactagaaggttcgaaggttttaaatctctgtgaatgattttgtgattgtgtaagtagtcgagtccgctaagtacttgcttagcgatttttgctaagctaagttcggagaaagttgcttgtgattttaaaagactttctagtgtgccgacgttcatgtactccataaggataccgatgtcgccgccgggcatgtcgatgacaccgtggcacttgatgacgtaaggagaatccgtccggcgaaggatggagatttcacggaggatttgacggcgaatctcggggtcgctatcgccgtgaacgactttgagagcgtagattgcggatgtgcgtttgtggcggactttgtacacagttccgccgtttccgtgaccgagaacc

SEQ ID NO: 1187 - DNA, 331 bp, Nicotiana tabacum
gcctctgcaccaaaaacagcttccagtagcagcaatggcaagaatcaaggttcatgagctgaggaacaagacaaagactgagctactggctcagttgaaggatctgaaggccgagcttgccctacttcgtgttgctaaggtcaccggtggtgctcctaacaagctctccaaaatcaaggtggtaaggttgtcgatcgcacaggttctgactgtaatttcgcagaagcaaaaaactgctcttcgggaagcttacaagaacaagaagtacctacctcttgacctgcgccctaagaaaactagggccatccgcaaacgtttgaacctgtgctct

SEQ ID NO: 1188 - DNA, 173 bp, Nicotiana tabacum
gattatttaatagttttgtccaactttctcttagggaagtccagagagaagttattattaatatcctgttgatgtttttctctattttatattatactttccttttgggggtggggacacaatcaggtggtgtaattataatattgcttattatatattgtttctgtgtaaaa

SEQ ID NO: 1189 - DNA, 316 bp, Nicotiana tabacum
cgagaggagttgttgagcaataagcacactccttggagcctagtcgtttgattcatcagtttctgcgagcgatatagcatgagattaaatggcaaataccattgatttgattaagtgtacagtaagaaacacggcgttagtcgccttataaattagtacattaaggtaaatctgtattctatagtatctattatttagaggagcttgctcttggaacatggcgataatcgccttatcaattagtatacattcatctaaatctgtattctgttatctgtagtatatattatttggagcttgctctttacagggaaaa

SEQ ID NO: 1190 - DNA, 471 bp, Nicotiana tabacum
gagcacaggttcaaacgtacaggacaaaatgatgaagttagtgaatgcttttttcaatctcctgggaacaatactgataatttgtggttcaatacacttattcaaccatttctttgtggatatccgacaaatcactgcgtttggcgacttctatgagcacttggcgccatcgctcattcttctgcttgactgagtgttcgcgctgttctcggatcttcttcagagctgattcatccagagcggggtaaaatggctttgagtcagattttttcttatcctttttcaggtttttgttttttttagtcactgatttaactcctgacaaagctttttttccaattttgacatcggcattctgcacagagacaatcatcttcctgtaaatctgtgaaaccatttctgttaatagcgatgatgcgagacgcaatcagaagtttttcagctaaaaataaggtgaacttaaagataaaa

SEQ ID NO: 1191 - DNA, 523 bp, Nicotiana tabacum
taccttaaactacacaaacaagccatgggcaaattagaaactgtcaccaccacctctgctgccgccgccgatgactcgccggagctgaccaccaatttcaagctagtggggttcaagaatttcattcgaatcaatccccgttccgattttctctccgttaaacgcttccatcacatagaattttggtgcggcgatgctaccaatacggttcgccgtttctcttggtctctggggatgccaattgcagctaaatccgacctctccaccggaaactccgttcacgcttcgtacctccttcgtcccgtttcaggttcgcttcagtttctcttcactgctccttattcgccgtctatttcgacgccgtcatctgcagccatccccagtttctctacttccgtacaccgctcttttacggcaactcacgggctcggcgtccgtgccgttgctttggaagtggagaatgcttacacggcgttctccgcgagtgtttcacgtggggcgaaacccacgtttgaaccgtgct

SEQ ID NO: 1192 - DNA, 217 bp, Nicotiana tabacum
gaaatgcttgttataaaaatgtgtcacaagcttgaggagattccccctagctttgcagatattgaaacattgaagcagattaagttgattgggcgcaggccacaaactctggagccttcagctgtgaaacttaaggaagacatcgaagagattgaaggatgcaaccgtcttaacctcattatggacgtttgaacctgtgctctaaatcatcgaattc

SEQ ID NO: 1193 - DNA, 520 bp, Nicotiana tabacum
gtgccgctgatgtaacatataatgatgttggtggatgcaaggaacaaattgaaaagatgagagaggttgttgagttgcccatgcttcaccctgaaaagtttgtgaagcttggaattgatcccccaaagggtgttctctgctatggtcctcctggtactgggaaaacactgcttgctagagcagtggcaaatcgaacagatgcttgctttattcgtgttattggtagtgagcttgttcagaaatatgttggagagggagctcgtatggttcgtgaactattccagatggcacgctctaagaaggcatgcattgtctttttcgatgaagtagacgctattggaggtgcaagatttgatgatggtgtaggcggagacaatgaggttcagcgcaccatgcttgaaattgtgaaccaactagatggatttgatgctcgtgggaatattaaagttctcatggcaaccaataggcctgatactcttgatccagcattgctacgtcctggacgtttgaacctgtgctc

SEQ ID NO: 1194 - DNA, 410 bp, Nicotiana tabacum
tagagcacaggttcaaacgttaattacattccaataaaacatacaagcaactgctaagtggtaaggaagatagatctatatcagaaagcagtaggaaatacattggagaaaggctaataaggaaggatcattatttagggatcgaggattagatctaatcgctatcgctgtcgctgctgctgctgtcatgcccatcgtgcttcttctcctttttgtcctttttgtcctttttcttcttcttctcctctccttccttgtgatggtgctctccgccttcttctccatggatcttttcctttatcttctcaacaatcccttccttgtgctctccgctgctatggccgtgatcctttttgtgcttctcttcttccttgtgcttatcagcctcatggtgtttgtctttctctcct

SEQ ID NO: 1195 - DNA, 307 bp, Nicotiana tabacum
ttgttgagcaataagcacactccttggagcctagtcgtttgattcatcagtttctgcgagcgatatagcatgagattaaatggcaaataccattgatttgattaagtgtacagtaagaaacacggcgttagtcgccttataaattagtacattaaggtaaatctgtattctatagtatctattatttagaggagcttgctcttggaacatggcgataatcgccttatcaattagtatacattcatctaaatctgtattctgttatctgtagtatatattatttggagcttgctctttacagggaaaa

SEQ ID NO: 1196 - DNA, 490 bp, Nicotiana tabacum
agatcactgctcttcttcttttttgaactctttgtgcttgtcgatgttgaaggttctggtcccatagcttgtggcatggaaccctgtttgtggatttccatgtgcaactctggagccttagaggtaacttccaaagacttgcggtaaatgtcatttcctggatccgcatcaactgcctgctgaaagcactgagttgctttgtcaaagtaaatcttagcctcatccatatcaggagttaaaaacgcatgagatgtatgtgcattccccaaacaccaaagagtttcatgcttttcgggattaacctccaatgcctcctccaactttgaggttgcctcagaaatcatctgttttgattcaggaacgggctggaactgtgataattccaataacgcgcctccccatctcgttaagttatcagcatcgagtggattctgagcgtaggtggtttcggcagtcttacgagcgtgctcgaagaagagaaggcgatcga

SEQ ID NO: 1197 - DNA, 316 bp, Nicotiana tabacum
cgcatcaaagcgcttagtagacgaaaaactagaagtggtggacttcacgagccaagtcaacgtctcagctgatccggggcactatgtgatcttctgggaactgagtggtgaagcaactgatgaaatgttgcaagattgctgcaactgtttggacagctcgttcatcgatgcaggctacgtgagctcccggaaagtgaatgcaattggagcacttgagctgaggatagtgaagaggggaacatttcataagatattagaccattttgttggattaggaggtgcagttagccagtttaatactcctagatagatgggt

SEQ ID NO: 1198 - DNA, 311 bp, Nicotiana tabacum
gggatttggagtatggtctttgtgggatgcattccatgatcgggaatctgaggaactggctgaagttgaagcagagctggacgcggatataacagctaatggtggagcaatcaaggagaagaataaggattctgacgagttaaagaagcagaggcggcctcttctcactcaattcttttcacccatctttctgaaggcattttcaattaccttctttggtgaatggggtgacaagagccagcttgctaccattggtttggctgcggatgagaatccactaggagttgttcttggcattactttgggacgtt

SEQ ID NO: 1199 - DNA, 573 bp, Nicotiana tabacum
attcgctaaagtgtgccattgatcacattcttgaggctgaacagaagggagagatcaatgaggataatgtcctttacattgttgagaacatcaatgttgctgcaatagaaactacactgtggtcaatcgagtggggtattgctgaactagtgaaccaccctgaaatccagaagaaactccgtgacgagattgacagtgttcttggagtaggagtgcaaatcactgagccagaactcaacaagcttccttaccttcaggctgtaatcaaggagacccttcgtctccgtatggcaatccctcttttagtcccacacatgaaccttcacgatgcgaagcttgctggatatgacattcccgcggagagcaagatcctggtaaacgcttggtggctggctaacaaccctgctacctggaagaagcccgaagagtttaggccagagaggttctttgaagaggagaagcacgttgaggctaatggcaatgacttcagatatcttccatttggtgttggtaggaggagctgccctggaattatccttgcactgccaattcttggcattactttgggacgtt

SEQ ID NO: 1200 - DNA, 286 bp, Nicotiana tabacum
caactctcggttctcttgacctgttgtttgcctctgcttcttgcagactttgcaggataaccagaattagcaaatatgaagtgtgcaggaaggatgggaatccactatatgcagaaattgaacgcggcgaatgttccaaaagaattagtagaaaaaggacagaatcgtgttatagaagcatctcttacacttattcgtgaaagagcaaagcttaagggagagcttattcgtgctctcggaggtgctgtggcctcaacgtctcttcttggcattactttgggacgtt

SEQ ID NO: 1201 - DNA, 430 bp, Nicotiana tabacum
acccaaggagactcgtcttgtcagggtgccttggagctttaattgtaatgaccattctgtctgctgttgttggttgggctgctcccaatttggtctcccgcaaatggacccatcatattacaacattgttgttcttgggatttggagtatggtctttgtgggatgcattccatgatggggaatctgagggactggctgaagttgaagcagagctggatgcggatataaaagctaatggtggagcaaccaaggagaagaagaaggattctgacgagttaaagaagcagaggcggcctcttctcactcaattcttctcacccatctttctgaaggctttttcaattaccttctttggtgaatggggtgacaagagccagcttgctaccattggtttggctgcggatgagaatccactaggagttgttcttgg

SEQ ID NO: 1202 - DNA, 169 bp, Nicotiana tabacum
aaacgtcccaaagtaatgccaagaaccttctgatttgataacaacaaacgaaaaatgaacagtctctcccatttcaaccttatgggaaaaacattcttctctgtctatcacaaatctaatccctaaagcccctctggaactccatgccaccaccaatagcgcaatcaag

SEQ ID NO: 1203 - DNA, 253 bp, Nicotiana tabacum
tgctcctcactgattttgtctgttgccgctctactcaggaactagacgatatgatcgatagctccttcctcgtcgatttgatgattattcattgagttgttttaccgcccggtatttatgtagataatacacattgtatatttatgcattttggtgagatttttgttttgtactagtagggattattgtacttgtttttgtataattattggtttggctatataataaaagactgttttcgttttgtattaaa

SEQ ID NO: 1204 - DNA, 320 bp, Nicotiana tabacum
gttcacttctctcttttaaattcaaaaccctagaaattaaatttcaatttcctctctctgaagcttctgaaaaatgtctggacgtggaaagggaggcaagggattgggcaaaggaggagcaaagaggcacaggaaggtgctgagagataacattcagggaattacaaagccagctattcgtaggcttgctcgtaggggtggtgtcaagcgtatttctgggttgatttatgaggagacacgtggagtgcttaagatctttttggagaatgtgattcgtgatgctgttacctacactgagcacgctaggagaaagactgtac

SEQ ID NO: 1205 - DNA, 334 bp, Nicotiana tabacum
gaagtgcagcaaattgggcaaattggggccagtagacatgttttagacctcattaaaaaaaaagactatattaacaaagacttgttatctttgttaattgctgctgttttattaattgtgtttcaagcattttcatcttctaaatggacctcagctttgtaaattgacttgaggttcctagatgggaagattgtctctttagcccttttttttctctttattttgtacatactcattttggggattaacctttgtataaatgagactctctcttagtttgctccatataagtttccatattaataaaaaaattcgcttagagttcctcacaaaa

SEQ ID NO: 1206 - DNA, 415 bp, Nicotiana tabacum
ctgatgagcagattcaggcttgcgaagaattgggaatattggtggatagggatgatcaggggaccctgctacaaatcttcaccaagcctgtgggggacaggccaacaatatttatagaaataattcagagaatcggttgcatgctcaaagacgaaaaaggacaggtgtatcagaagggcggctgtggaggcttcggaaagggaaacttttcagagctctttagatccatagaggaatatgagaagacgcttgaagccaaacaagttaatcaagttgctgctgcttgaccatataagtattaactttctttttgccctgtctaattgacattgtggacaaggcgtagacttggtattagtaccttagctgctgtttgatgtctctgttattaatgaaaaagcttatgtatataagt

SEQ ID NO: 1207 - DNA, 394 bp, Nicotiana tabacum
gccggtcttaatgtgttgcgtattatcaacgagcctacagcagctgccattgcttatggtctcgataagaaggcaaccagtgttggtgagaagaatgtgttgatctttaatcttggcgctgaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcat

SEQ ID NO: 1208 - DNA, 521 bp, Nicotiana tabacum
atcattgccaatgatcaaggtaacagaacgacgccatcctatgttggtttcactgattctgaacgtctcattggtgatgctgccaagaatcaagtcgctatgaaccctaccaacactgtctttgatgctaaaaggttgattggtaggaggtttagtgatgcctctgtgcaaagtgacatgaagttatggccattcaaggtcattcctggtgctggtgataaacccatgattgttgtcaactacaagggtgaggagaagcagtttgctgccgaggagatctcatctatggtgctcattaagatgaaagagattgctgaagcgttccttggcacaactgttaagaatgctgtggttactgttccagcctacttcaatgactctcagcgtcaggctaccaaggatgctggtgttatttcaggattgaatgtgatgcgtattatcaatgaacctacagcagctgccattgcttatggtcttgataagaaggcaacaagtgttggtgagaagaatgtgcttatctt

SEQ ID NO: 1209 - DNA, 340 bp, Nicotiana tabacum
agccaactggaaacttgctgatagtttttgaggagataggtggtgatgcatcaaagatttctcttgtcaaaaggtcaattacatatgtatagacatgatatcatttaggtattattatttaaaagaaaaatttggtgtgagatttatctcatagaaaagaaagggttctacgaaaagctcttatgctagtttttttggccaataattagcttatttgatttgctttcccatcatcttcattcaaaatgtggctgcagtgctactgctggtcttcctcatcgatgtacatattaagaagttattaatggaaaaagaactctatttgtttcatttcagaaaa

SEQ ID NO: 1210 - DNA, 256 bp, Nicotiana tabacum
ctaaaggaagtgttagtggatgaagaaattggtgaaggggctgtgtaatatcttagatatttccatatatgacttcctctttttcctattaaatacttgtcttttgttgttttatctttttgggtatcggtagggtatgggaaaagatgaaattagaaaagtgctgcctttaaagctcaaatgactatgtactttttaatttgatgctgcagcttaatgttaattcggataggccttagttctttcttggccaaaa

SEQ ID NO: 1211 - DNA, 384 bp, Nicotiana tabacum
aactaagtcctcacggatgacagcgggagcgggtgtcggcgacggcggaggtgcagcggcggccattttctaggggaagttgaaaagagagaaaattttgttccggtgaatttgggggttaatggttagtgtgaatgttgttgtgggatatatagggcggtaaaatacctagaaattgaagggagagagaggtaaaatagaaagaaaaaaaaagcttatggatgttcatttagtacttcgttgtaaataatcttcctgaataagcttattcatatgagattccaccgtaaatatgtttatctatttagtactctattggaaataagcttcctgaagaagcttatcacttcggtacccagttatgaataaacattaccctagggg

SEQ ID NO: 1212 - DNA, 224 bp, Nicotiana tabacum
gaggggaaggacctggttctgtcagtgatgtctgccatgggagaggagcagatttgtggtatcaaggacgttggccccaagtagctgcaggatgtggtggtgtatgttacaaagtttcaaaaaaagctgtatcaaagctatgtagaagtaccaacacttttttactttttgttgttccagataactgctattcaactatatgctatgactggattcttgtaaaa

SEQ ID NO: 1213 - DNA, 265 bp, Nicotiana tabacum
cacttttccttgataataatcctcttttgaactcaaaatcagaactttgatcctttgcacttgcgatttgcttactctctcgatttcactttctctgaaccagcaaagccctatttctaaagctatatatggctcaatccagcgataatgttgttggagttgataacacttttcggaaaaaattcgataaagaagagtatttgcagcgtgctcgtgaacgtgaagagaaggagacggagggaaagaaatccaagtcaagaggacc

SEQ ID NO: 1214 - DNA, 254 bp, Nicotiana tabacum
accattctgcggattctgaggcagggagacaactaggtgcagggagtgtcacctgatgcgcatttgtttatttaacaatttttaagaattttgctttgctttgtttaagaattacgcagatagattgtgcgtctctctgctcgtatattacttgtaagtagtgttaaagtttccaatgttttgatggtgtcaagtacaatttccggaagttcaaaataaagtatcattgatgttgcacaatttctggtcgaaaa

SEQ ID NO: 1215 - DNA, 235 bp, Nicotiana tabacum
aatattctttttgttctcaagagtttgatagatgtgaaaatgatgaagcacagcaaaagaagcctttagatagaaacaatattttcttggaattcttgaaaaacaaggatgtagcaagttttgtgagactaggaagagtcattgtataggatttaatttttgtaatttgatagtgtaattttgtttttacactattagtgtaatttaatttattatagtaagctttcatttaaaa

SEQ ID NO: 1216 - DNA, 452 bp, Nicotiana tabacum
caataatctccctctttctacaaaaaacaaaagagaataatgactggtacaaaaactaatgattttcaagatatgttaccaatgatggcaaataagctaggtggggatggtttaattagagagctatgtaatgggtttcagctattaatggatagagaaaaaagggttattacttttgagagtttgaagaaaaactcagcaattcttggtctacaaaatttgagagatgatgagctgatgagtatgttgagagaaggtgatttgaatggggatggtgttcttgatcagatggaattttgtgtgcttatgttcagattgagtcctgaattaatggaagaatctgaagatttgcttgaattagctttgcaacaggaattcaagactaatccaacaaggtgatttgatatctgatgttccatttgaaactcgaaaggaaaatcatttgaaccttc

SEQ ID NO: 1217 - DNA, 292 bp, Nicotiana tabacum
aagcagcagcagcagcagcagaagggatggtggccaatacattattgaaccaaccatttcaagaagtcattttactataagataaaagtatagaatgtcatttgaaaatgtggtaatttgcctgagtgttagctagcgctaacgccagcatcctccgccattttttccatttgcttttagtcagttatacagtaagacgtttcgtgtcaatgtggctataatgtccgtgagttagctagcgctaacgccggccaatgccacctctattaccattttttgtcgtgaaatcttt

SEQ ID NO: 1218 - DNA, 253 bp, Nicotiana tabacum
acgaggtagggttctttgaaatcgtgaaaaaagagagagagaaatggcagagcagctaacggaggagcagatcgctgagttcaaggaggcctttagccttttcgacaaggacggtgatggctgtattactaccaaggaattgggaacagtgatgagatcacttggtcagaatcccactgaagctgaactacaggatatgatcagcgaggttgatgctgatcagaatggaaccattgattttccagagttcttt

SEQ ID NO: 1219 - DNA, 94 bp, Nicotiana tabacum
gaaaaagctttacagttggcctgatgtagccaggaggacagaaattgtttacaaccgtgctttgaaatgctccaatccacctttgctagatcga

SEQ ID NO: 1220 - DNA, 456 bp, Nicotiana tabacum
aagggctttatttttgtggagcaacgatcacattgagaatttgataaagcaaaatcgaaaggtgatactgcctatcatctttcctgcactggagagaaatgccagaaaccattggaatcaggctgttcacagtttgtcactgaatattcggaagatattctatgatcttgatcctgatctattcaaggagtgcttgcacaagtttcaggaggacgaattgaaggaagatgagattaagtcaagacgtgaagctacatggaaacgattagaagatgttgctgccaaaaattctacaagtactgaagctgtgcttgtgccgtccactgggcgttctcgaacttaatattaagatatgcttgttcttccttgttcttcattttgatatttctggttagtttacatttcggaagcagtgaatttattaaagggagaagggattttttgtgtcattggctt

SEQ ID NO: 1221 - DNA, 289 bp, Nicotiana tabacum
gcccttcccggtggggtgccagaggccaccaaggggaaatggaagtggaaatgaacccgctacttcgtttccatctgttcaatcatctaaacctgcagcaaaccaagcaccagcacatttcatttgccaacttatgatggctctgttttccctttttagctattatttgatcattatttcttcatgaggctttttattgccctttgtataatattgagctctgttaaatgatcgcatagaattgaagcgactaagtacagcatgtttgatattgctgtttataccaaaa

SEQ ID NO: 1222 - DNA, 292 bp, Nicotiana tabacum
ccaaagtgtcaccaccttctcaggagatctctactggttttgcaaattttgcaggtctgatagggcccttctctaaagaagccactggttcttggtagtcttcaggctaggctctacatcttcaattgtcatgatccggatttcccaccctcgggagtcttgatggcgcctacctgtgaaaggtaggcaagccgcattatgtagaatcactaactcttttagttaaccctttttaacagtttaaattaatatacgataaacaatgaaatattaatgataagtagatacaaaa

SEQ ID NO: 1223 - DNA, 424 bp, Nicotiana tabacum
tacgactttgatttcacgactgaagaaaacgtccagaagagcagaatattcttcattgcttggtcacctgacacggcaagagtgagaagcaagatgatttatgcaagctccaaagacaggttcaagagagagcttgacggtttccaggtagagctgcaagcaactgatcctacagagatggggcttgatgttttcagaagccgagttggtggaattgaatgttgagtgcacgagtttcttgcttatgctaagtgattatagtttgtggggaagtagaacgtggttagttatactattggcttgtcgttcgcgttcatcgtactcttttaagtctcttcttctcagagaacttccaatactctttaatatgttatattgttactcatgaagtcaaggagctactttgttattttgagttttaaaa

SEQ ID NO: 1224 - DNA, 487 bp, Nicotiana tabacum
aagtgcggcaacggctgtggcggatgcaagaattacccagatttgagctacaacgaaagcaccacaactgaggctttggtgcttggggtgggacctgagaaaacaagcttcggcacaatggaaatgggtgaatcccctgctgctgagaatggctgcaaatgtggatctgactgcaagtgtaacccttgcacttgttctaagtgaacaaattaaatcttaattaagcagagatggatgggtgttagccttttatggctaagataaaaaataactatagtttttaaaatgtagtttatagttgtgtctgttgaaaacagggggaaattatgtgttttttcctctgtaataaggaagagtaatggagtctgaacaatgtttgggttcttgttattgtggcgttgtgtatacaagtagttgtgtggtttgtaacatgagcatctctgcttctggtgttttaacctatgttatttcctttttcccgatcaaa

SEQ ID NO: 1225 - DNA, 390 bp, Nicotiana tabacum
  modified_base (270)..(270): a, c, g or t
ctcatatttgccgtctcgctgataccattcatcttgtccacgccgtctccagtttgagaaatgagatcgtctatgaagctacacaggccctcatggagaagcttgccatcgaggctttcgaggttgctatggtgaagacagtggctaggattgtggaaggagatgctggaaaggtaatatgcaaggaagcagaaaggttgaagcctgcagcggtggttatgggaaccagggaacgtagtttaatcaaaagtgtacttcaaggaagtgtcngtgagcattgctttcaccattgtaaaacagccccaatcataatagttcctggaaaagaagcaggggaagaatctgtaatttaatggaacttgccaagtttgagtactgctgatgatcatt

SEQ ID NO: 1226 - DNA, 483 bp, Nicotiana tabacum
aggaaatggcaacagtagttgatgcttgtgtgtgtgagattacaaagctaagtgagaaggtgagaaacagaagctttttcttgttgaaatctcagaagaagaaaaagtcaggggataaagtggaagaaagcaaaaatagccagaattcttcttctacttcagtggcagagacaaagaatgacaacacaatgtgtgaagcaactgtgttcttgctcatggaccgtcttgctccttgttgaaaccatgatttttgatgttttaattaatacccaagtatagtgtataatctcttagatttttttatagtagtatgtataaatgttcttgtatatgtatcttatgtaagaaggttatatcatttagcctgtagtttattcatcatcccaacttcagtttctgtccatttctggttgtgtaattttttggaaaatattagcagatggatgttatatattcctccggaaaaatcattcataaataaaa

SEQ ID NO: 1227 - DNA, 457 bp, Nicotiana tabacum
caacaaggcttccctttaatcttaactttgtcaaacatctttgcatatctagtatttgtctgtttgtcttggaagaggtttcatttgctctttgcttgctaagaagtttcccatgtttacaatatgtggaaattaaggtggaggccggtgatggcaatgatatacctgccctagaatgccttgaagtagaacaattctcagatgtgtcatttaagcacctcagggaagttaagctaatacggactaatggcacaatccgtgagatgcagcttatgaagcttctgttagccaagtctccagtgctggtgagaatactaatcgagccatgtctagttgaagattctgcaactgtcaaaatacttgctgaggtaaaaaaatttcagcgtgcttcacctaaagcagaagttgtctgtaaacttcaataagcatccatattaccatccttttttatcatctc

SEQ ID NO: 1228 - DNA, 575 bp, Nicotiana tabacum
gtcactgcctatattgccacttttaaaacaaaatatccgtatatatctacagtttcctaagatcagtttccctgacgaaaaggccgtggaaaccgtaaggcactcgacgaggcaatttgacagcagtcacaatgtcaagattaggggactttgcatccatgaccaagaaccttgactctcctgtcttctcattgtgcacatacgacacaacgtagccatcgtcctcatccgctgccgaattgttgggatcctttgccacaaaaaatggctcaccgccaaagcagccttctccaaataatcggcacgccactatgcattcgcgccgatcagcttctgctactgatacgtccaattttgctatgcctgctatctttggcatagggtctccaatcgctgcatatacgtacttgttcttcttcccaacataagccggattgatgactccaaaatcaagattccttgtcgacactggatgtctgctcaccatcccactcttcaaatctatcttcactttctcaacagaagcatgtatcatatccattctctccagcgtatgctccaccgacaatatattc

SEQ ID NO: 1229 - DNA, 234 bp, Nicotiana tabacum
cattggacaaacaggggaaaagttggccatagatctgctagcacaataatcttgttacatcaagtcatccagggaaaaagctaatttagtttgtggttattccatcaatgatgaagatatgttgacttcctttcttgatgagctttctaaggtggttcatttaccgcggtaaaatattgattgaacacataattatgcgaaatggatctcttctatcttgtgtttgatttaaaa

SEQ ID NO: 1230 - DNA, 477 bp, Nicotiana tabacum
ctctttggtaaaacagttcctaaaacagcagagaacttcagagcattgtgcacaggggagaaaggtgttggaaagagtggcaagcctcttcattacaaggggagcacattccatagaataatccccagtttcatgcttcaaggtggtgatttcactcttggtgatgggcgtggaggtgaatccatttatggtgaaaaatttgctgatgaaaatttcaagatcaagcacactggaccagggcttttgtcaatggcaaatgctggtcccgacaccaatggttcacaattcttcatcacaactgtcacaactagctggttggatggccggcatgttgtctttgggaaggtgttgtctggaatggatgtcgtttacaagattgaagctgaaggaagacaaagtggaacaccaaaaagcaaagttgtcattgcagacagcggtgaacttcctctgtaatgggatctgataagtgcaatatgt

SEQ ID NO: 1231 - DNA, 308 bp, Nicotiana tabacum
aagtctctcccggaaataatggtcaatatgcaccatttgttgctcctgccatgcaaaatgtatataatgcattagcagcagcagggttgcaagatcaaatcaaggtctcaactgcaacatattcagggatcttagcgaatacctacccgcccaaagatagtatttttcgaggagaattcaatagtttcattaatcccataatccaatttctagtacaacataaccttccactcttagccaatgtctatccttattttggtcacattttcaacactgctgatgtcccactttcttatgctttgttcaca

SEQ ID NO: 1232 - DNA, 487 bp, Nicotiana tabacum
gtttcttactctctcatttccattttagctatgactttatgcattaaaaatggctttcttgcagctgcccttgtacttgttgggctgttaatttgcagtatccaaatgataggggcacaatctattggagtatgctatggaaaacatgcaaacaatttaccatcagaccaagatgttataaacctatacaatgctaatggcatcagaaagatgagaatctacaatccagatacaaatgtcttcaacgctctcagaggaagtaacattgagatcattctcgacgtcccacttcaagatcttcaatccctaactgatccttcaagagccaatggatgggtccaagataacataataaatcatttcccagatgttaaatttaaatatatagctgttggaaatgaagtctctcccggaaataatggtcaatatgcaccatttgttgctcctgccatgcaaaatgtatataatgcattagcagcagcagggt

SEQ ID NO: 1233 - DNA, 367 bp, Nicotiana tabacum
caagtacaattgcagcattaagaaacctatctttgtccaacaaaatggacaaactattcttggtttcctcaaattcactgcccatttgaatctttcttttcattttcttcgctgatctcttctgtactgtctacttccctatcttctgtgacagcatttattggacgaacaagactagtttttgcagaaagagttgggatttgtagtgaattttgtcgggtgatgtgcggagaaaagttgatggagaagaattgagtatttctggattttgagggagaagggagggtgtgggtagcaaaatttttgagagctgacatgattggtaggttgttccgaaagagaaggaagttcccctcgtgccgaattc

SEQ ID NO: 1234 - DNA, 338 bp, Nicotiana tabacum
gcacaagtacaattgcagcattaagaaacctatctttgtccaacaaaatggacaaactattcttggtttccacaaattcactcccatttgattctttcttttcattttcttggcttatctcttctgtactgtctacttccctatcttctgtgacagcatttatgggttgcacaagactagtttttgcagaaagagatgggatttttagtgaattttgtcgggtgatgtgtggagaaaagttgatggagaagaagtgagtatttctggattcttgaatggattttgagggagaagagaggatgtggccatggtttgcaaaattgttgagagctgacatg

SEQ ID NO: 1235 - DNA, 122 bp, Nicotiana tabacum
cacactgctaggattactacttgttgccagcaccattgagatagcaggggctcaatcaataggtgtttgctatggaatgctaggcaacaacttgccaaatcattgggaagttatacagctct

SEQ ID NO: 1236 - DNA, 250 bp, Nicotiana tabacum
tgattaatattccactcaccaaagacctctgattctttttttattttcctttattaggttcacttttgtgttggctaatttgtgtgattattttgttagtggtgtaaagagtagattgttcattctaacatgatgtctagtgattttgtaagctgctgactgctgaacaaattttacatgaaattcttttcctcccagaataatacaaatctttgcacggtacttattgacctggttctctacctcaaaa

SEQ ID NO: 1237 - DNA, 441 bp, Nicotiana tabacum
gccaaacttaaataaatcctagatctcaaattgggacaccccagcaatttaaacaaacttttatatgtgcagtttgtcagtacccagtagtggtggagtcttttaatttgctggtctgaaaccttcttcttcatttttcacgaagccaaacaattagagctgaaagaatgagtctttctacagcaattacaacatggggcaacacctattttgcccttggaaataacggcagatccagattttactctcatggattcttacctactcatccgaaggtcaaattctccaccaacaacccttccccgctttctgtctcagctcttcttacaacaaaacaacaaactgatgaaagcaagaacaagaaaaaacaagcaatggagttcaatgattacgttcttgaaaaagctaattctgtgaacagggctttggaatcttcagtct

SEQ ID NO: 1238 - DNA, 468 bp, Nicotiana tabacum
cttttcttcactcttcgcccaagcaaataaccatgtcttgttacaagggaaaatacgccgatgagctcatcgcaaatgctgcatacatagccacccctggtaagggtatccttgctgctgacgagtctactggcacaattggcaagcgtctatctagtattaatgttgagaatgttgaggaaaaccggagggctctccgggagctgctcttcctcacacctggtgctcttcagtaccttagtggagttatcttgtttgaggaaaccctctatcagaagactgcatccggcaagccttttgttgatgtcttgaaggagggtggagttctccctgggattaaagtcgacaagggtaccgtagagcttcctggaaccgatggtgagacgactactcagggtttggatggccttgctgagcgctgccaaaagtactatgctgctggtgctaggtttgcaaaatggcgtgcag

SEQ ID NO: 1239 - DNA, 433 bp, Nicotiana tabacum
caggaatttatgggtagccacaaagaatcacttccaagcagttatggccaattagatacaggcttgaggcagtcttcttactctaacctaggcagtggctcctattcatcttcttcatacggcggacagcaatatggtggtggcggcagctatggatcatttggtgcaggagggtacagtagctacaggtcatgaacagattagccttgagtcttagcactcgtagttacccgtactgttttgttcgtatgcgttttgtgacagagcaaacactgaagcaactgcaggtggttcatgctatgttaatctgatgtctcttactgcaatgtattgatagcttttcagtagctcaccatatcttgtagttctcacatgtgtcggtatgataacattgaattttgcaagtgtaatggttaaggtgtggttcttaaaa

SEQ ID NO: 1240 - DNA, 331 bp, Nicotiana tabacum
  modified_base (87)..(87): a, c, g or t
gcccagaacacaagtacagccaccatagcaagaacatttccatcataataggattactcaagaacgataatgaaggattatacatangacctccaaaacaaaaggggacatgtttacatcacaaatgtgacgctagagccaaatggagaaactgcactacaaatgttctaaaggatgataagtagccgattttatcagcttattacagacggggcttgccagtttatttgacagagaagcctagaccacaaccctaaggtacataagtgatttagcgatactgaggagccagttccccatccttgacaatgtaattttgtgctgggaaatc

SEQ ID NO: 1241 - DNA, 129 bp, Nicotiana tabacum
gaaaagggtcctctgtttctcttaaactcatacgcaaccaaagggttcactttcatcaaagctcttgcaagatggcggatgttgaggatattcaaccacttgttgttgacaatggaactggaatggtcc

SEQ ID NO: 1242 - DNA, 325 bp, Nicotiana tabacum
gtaaagaatgcggtacaaacttcagcctccacaccacctacctttacccacccgatttttacttcgaagcaggcaataaaggtactctatctttctccgccgttgattccaccaaattcaagttcgaaaaagaagataaaatcaggcctttttttgagaccatcaattactggggtatccaaaggaaaaggaccaagatggcgtgcaataactgtgggaaggttgtgggatatgtgtatgatgatgggccgcccatgactgatagtccgggtcagtttcactttggacctagtcaggttattcctagagcccccagatataggat

SEQ ID NO: 1243 - DNA, 191 bp, Nicotiana tabacum
tggacttgggttgtgtgcggaacatggtggttctgttttcaaaccttttgttggagaggctctttcgagaatcaatgtagtgataacacatctacacgatcgtgagcctgagaatttaagtgcatattataatgctgcttttgcgcttggtaagatatgtcaatttcatcaggaaagtatcgactcagcac

SEQ ID NO: 1244 - DNA, 503 bp, Nicotiana tabacum
gtagcacctccaccaatgccaccaacagaaggtagatacgaagttgtaatagataatgacatcattcgacgacttgatttatccccatttcagattgcaactggattatcatcacccttatctgccaagccaaaagagtttctggaaaggacaattggttttacaatcaactacgcaaaagaagataaatatgatccaagggaattatcagaatttccagatatacgactatggttcgttcgactagatgctacttacccatggttgccagttttattggattggagagctggagagcttgcacgttatgcagcaatgttggtaccccatcagatgagtatgaaaatggggatagtattcaatccagaggcattggagttgtttgtgatgaataaggtgtttgttgtgtattcttggttgaagcaaaatgagattccaatgccaagactgaagacaaaagatatggcaagaatgcttggttttggaattggggatgaactttt

SEQ ID NO: 1245 - DNA, 444 bp, Nicotiana tabacum
gtttgactcaaccctctttaatcacaccatgaatggttcctatgtggttatttgtctccatgccccagaagccaaaaggccaaagggaagaattttacgaggaaataatcataggatttttacttttccattggctcagcctcaagtttagttgatgcagatctccaggaacatttcagagttgtatgaattgccataagatgatattcaatgtcttggggtgcattttctgctgtatctgccctgaaatttgatgcatgtggaattggtcattggtctgtatttttgtgtctctcacatatggaggaacagcctgggacctggaagatccacatcaggtcacattgttgcagagggtacagataaatcaatctggaggggtctggaacatacaactgtgagcagctctcttgacaatcaaatttggagatctggagcacccag

SEQ ID NO: 1246 - DNA, 382 bp, Nicotiana tabacum
gcggcatcactggatgcagagtacttcgtggcacggcacctaaacgtgagactcatgagtcactccccctgcttgtttactttttctgtgttgtttgacagaactgttgttgtgtcgctgaaactagtgtagttttcgtggtggtttcaaattaatattgtttcgtattgaccttagtttttgtgtcgtgtttctccttcaaaagaatcaaaatgtggtggagaagtaacgagaaaagacatttacccatcgccgaaggcccccatgctccaggatgcatcgacataatgacagaatattccaaagaagggtgttttgtccgactctactacccaaccaacatatcaatcactgacataaagaaaagagtcatcaagatggg

SEQ ID NO: 1247 - DNA, 565 bp, Nicotiana tabacum
agcacctccaaatgagtggcctgagattgtgggagatgataaatccaacctgcccttaaattcatttagaaacagagtcgaatctaaaagattttctataggaccagcatttatggagtggagcaagtctaaagctttggaacactctttagaccttattttgacctgattgcttttctccgcataatgctgtggaccaactgtaaatttttgatgacggatccatgtgcgttgatcattgttttttgcttcctccgattcataataataggttgcacaagctgagtgatccctgtcctccactgaagccaccacaaaacctctggaagcaagctcgcaacaaaaagtagtacagacaaaccggcaggccccgaatccgtgagagaaaattatcgttttgaacttatcttctttcaagagaggtggtcctttctcaatgacaggtatgtgaagattacctccagaaatgagccagatggaccatttgaggagagagacccagatgctgacgactgaagcgaatccttcctcgtagttgggatgagccatccaccgaaacccatct

SEQ ID NO: 1248 - DNA, 438 bp, Nicotiana tabacum
taagaacaaatgctagaatttttcagcttagcaagtgtactgcttgcacgttcacactcgaccttcctgctgtacacttcatgtgtatgcactcatttcatcagcgctgccttggcgacaatgagaaagaatgccccgagtgtgctcccgagtacagagctgttctggaaacaaagagaagcttggagcaaagttccaaaaacccagaccagttctttcaactggttcagagctcaaaggatggattttctgtaattgccgattactttggcaaggggattatcagcaaaactagcaatgggcatgctgaagctcttagatcaggcagcgcttcttctagcaacgatttctaggatttgatcaggactgatcatcaagctgtcagcatatttgttgtgtaaccatattcttgagatcttttcagccataattagggga

SEQ ID NO: 1249 - DNA, 164 bp, Nicotiana tabacum
ctatggtgaagtttgctcacgtcgttgctttcttgcttcttgcatcacttattcaacccctcactgctcgagatttggaaatcaatgtcttgcaacttgatgtgtctcagtctggttgcccaggagtgacaaaggaaagatggccagaacttcttgggacacca

SEQ ID NO: 1250 - DNA, 299 bp, Nicotiana tabacum
agcacctccaaatgagtggcctgagattgtgggagatgatagatccaacctgcccttaaattcatttagaaacagagtcgaatctaaaagattttctataggaccagcatttatggagtggagcaagtctaaagctttggaacactctttagaccttattttgacctgattgcttttctccgcataatgctgtggaccaactgtaaatttttgatgacggatccatgtgcgttgatcattgttttttgcttcctccgattcataataataggttgcacaagctgagtggtccctgtgct

SEQ ID NO: 1251 - DNA, 378 bp, Nicotiana tabacum
gcacctcctccagttgatatgtggctcatcttttctgcaagtcctaccttttcaactgcagctacagaatcaccaccccctattatggttgtcactccctttccactaagctctgccagtttctttgcaatagcctctgttccagcagcaaacttgtcaaactcaaacacacccattggtccattccaaataacagtcttggtggtatccaaggcgctgccaaatgacttgattgcatcgggtccaatatctaatcccatccagccatcaggaatttcagatgctggaacaaccttgctgttcgcatcagcagcaaacttgtcggcaatcactacatcagtgggaagcaatagagataccccttttgcctttgccttc

SEQ ID NO: 1252 - DNA, 500 bp, Nicotiana tabacum
gcacctccaccaaacccaccagcataagagccatagcgactagaatagccgagtgagggatctccacggtaaccaccaaattcaccaccgccaaagtctccatatctaccaccatattcaccaccaccatatccatagtcaccaaacctaccacccatacctccagaagacctataagaagcagggccaaaaccgccactgccaaaactgctgtatgaattgccaaagcctccgtaactatcactgtatccacgtcccctagactcactaccatagccatgaccagatgatgctgggtttgagggtttcttaggttctgccttcttgatctcaacctgggtacccagcatatcaatcatatttccctcggacagcacattatcaactactcctcgtgccgaattcggcacgagggaaagatacaaattatgaaacatagagtagtgacaagagggggcaaggacacgaagcggtcttcagtcttcttgatgcaaggaaga

SEQ ID NO: 1253 - DNA, 466 bp, Nicotiana tabacum
gcaaaattgaggactcttattgcattcaacaaagaaacgagtacacaacaatttctactgaagaataagtaaactgaactacaaacaacagcttttgaattcaaagttcatctatactgaaaccattttaaaaatagcagcctccattttttctctttagggtaagaggctgtaatacgtagaactcgggactctgtttaggcctgatcattcaacagaatcttataatcaaaagtacggcacttcacttgggcaatccggtataagggttgagaagagcttgactttcgtcgcttatcaaaactggacctctaccaggtcttgtgcatatgaagtagctaatttcgcccttacatttctgaactggaaccttgtccttaatttctggaggtggaggcaatgcttccacatcctttatctcctgaattccagcatccttcagtattgatttatcacctatgacgta

SEQ ID NO: 1254 - DNA, 191 bp, Nicotiana tabacum
gtcctcaatgaaagagagatcaattaatccgaaaagactagaaggtaggttcagcttggtaaatgaaagtgtaggaaacgatacacctaagaaaatgccaagcacaactccagcaaaggttgttacaagaagcctcatcatttcatttcgccgtttggtgtttgaactgcgtgtaggtgtccccattctgt

SEQ ID NO: 1255 - DNA, 458 bp, Nicotiana tabacum
tcatcaagaactctcaaaatattcagttgaaggaacacagtgggtgtctggtaccaacgggtatggatgcatgtgtgagcaggaaaatagcacgtggatggtctcttctgtacctttggcagggaatgttcaccatcaatggtttgatgtggggaattgggaggttgccagactttctgctggacttcttgcagcacaagctgtctcatcacttcagattgcagaagatgctccaatggactcatatgtcttcagtcggatgctgagagagtgaactgtggaggtctaacgtctatcatccagttggttggtactttatgagatgtttttttttatttgtgtggtttaggataattccatgtatatatatttttagtgaactcaatccgcattgtttttgacttattatgcttgtgtcggtcatgagcccttaaaattcactaaatagttcctggaaa

SEQ ID NO: 1256 - DNA, 341 bp, Nicotiana tabacum
agaactatgtgctgtcttaatcagactttcattaattgccttgcggacttttttacatgtcagaattcaataaaaattaacccaaataaatatttaaagaaatattttttaaaaaaacctcttactatggtacactaattaattaccttctccctaaggcctaagtttctccttttcttcaaggaaaatgaatcagaccctcttgtgttttgactttctgtgaagctactctgtatttacaattttaggtccctgaacatatcaagattgtgttcgccttgaacttggccgtatcctttggaatggtcaagctcatgcaataccgacatcagtgaggcctt

SEQ ID NO: 1257 - DNA, 374 bp, Nicotiana tabacum
ggtcactgtacgtattgccagaagactcactcacaacatccaaggactcacaagccttcagagagttggaattggactagtactctccgttgctggtatggtagcttcagctttggtagaacgactaaggagggaccgtgccatccatgacaacttcaaaataagagctttttggttagtccctcaattcttcattgtaggtgccggggaagcttttgcctatgtaggtcagcttgaatttttcattagggaggcaccagaagggatgaaatctatgagcacaggcctatttctcagcacactctcaatgggatattttgtgagtagcttgctagtgtcccttgtaacaaaagtaacaaaaggaagctggctta

SEQ ID NO: 1258 - DNA, 541 bp, Nicotiana tabacum
agcacctccaccaatgccacaaacagaaggtagatacgaagttgtaatagataatgacatcattcgacgacttgatttatccccatttcagattgcaactggattatcatcacccttatctgccaagccaaaagagtttctggaaaggacaattggttttacaatcaactacgcaaaagaagataaatatggtccaagggaattatcagaatttccagatatacgactatggttcgttcgactagatgctacttacccatggttgccagttttattggattggagagctggagagcttgcacgttatgcagcaatgttggtaccccatcagatgagtatgaaaatggggatagtattcaatccagaggcattggagttgtttgtgatgaataaggtgtttgttgtgtattcttggttgaagcaaaatgagattccaatgccaagactgaagacaaaagatatggcaagaatgcttggttttggaattggggatgaactttttgacttgattgataaacaccatattgatacttcataaagt

SEQ ID NO: 1259 - DNA, 449 bp, Nicotiana tabacum
gcaagcaagcagcattaaacttaataggctgattatttttccagatcatacagttcaaacaccataaatacaagatattttctagctaggctgagcactgagtcattacatcgaacaagagggcggggcgggggcggatgaaagagcttcgaccccaaactccgatccgtgtaacttttgcatgccatttcttaggtaagcagcttcttatgttttccaggttttcaaagaatttacaaggttactaagctatgacagctcactctatggatgacaggtcatttagccttcatcctctgatttagagtcataatctgagttgtcctcaagctttacctccacttcgaccacctgcactgggactgggaatgtgggtgcacttcctccagtaaaaaaggaagaagagggccaaccacgaacccttgacacgcacgccgtttcatcctccg

SEQ ID NO: 1260 - DNA, 360 bp, Nicotiana tabacum
caagcaagcagcattaaaccaatagttttgtagtcatgtaattaccaaagctatagccaagtggaagcaatggattggagctcatccacgtatcggttccatacctcaaagaagcattctttttaatgtccacctaaaattttccttccaattacaaatgatatattcttcagtggctcatacctgtgaagagttttgactcgcacatatttttcatggagccgtggaactgtattatctactctattatgtgcacaacatatgattcttgccttgtcaaattgaactgcatttatgcacttctacagttaaatccaattgatcattgttggccttccatttcaatgacccgttttatat

SEQ ID NO: 1261 - DNA, 480 bp, Nicotiana tabacum
agcaagcaagcagcattaaagttctcaaagttgatttcttcttcttcatcttcttcttcttcaaaattttcaagaagattattgttgttgatgtcattatcatttggcttgctcagctcaatcactttgttgtcatcactttcagattccatagcctcttctttcactgcaacacctctgttttctccattctcagtatacacctttgatttcagctcacgaatctctttcaagagagcttcattgtcatgtttgagagactcataattatgtttgagggcatcaaaattggctttaagaacaccataatctctctctaattgctttgttttccaacgagcacgtctgttttgaaaccaaacagcaacttgtctaggctgcaaaccaagttcttgagccaacttcactttcctttcaggttcaagcttattttcaacttcaaaattcttctctaaagcttttacttgttcaacacttagt

SEQ ID NO: 1262 - DNA, 476 bp, Nicotiana tabacum
taatgctgtgtgtactcaccttggttgtgttgtgccatttaatgctgcttgcttgcttcactaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctcc

SEQ ID NO: 1263 - DNA, 240 bp, Nicotiana tabacum
tttagaaaacaaaatttatttgacgtcggtactgaaatttcatcagacttgaaggaagaatattttgatactaaagatcacaatccaagcttctgcgctagcattttaacttgaattatagacatacgcaagaccgggagggtttgtgtcctcttaaaaaggaatacccaactaatacgcaatacaatctggaacgcattgacccaactaattaggattcgtgcccccataggattcatt

SEQ ID NO: 1264 - DNA, 306 bp, Nicotiana tabacum
caacccggtgcacaaagcatcttgcattcacgcggggtccggaaagggtcgcacccgaagggtgtgaggtagacaacctacttaatgcaagaattagtggctgctttcactgctcgaacctgtgacctatgggtcatacagagacatcttgcatcaaactttccatttctaacgaaaatagagtccatttctgcaattcctcaaatgttagttcaatgccatcagataattaattcccaataacaccaatctgcggaaaaacctctacatttttttaattccctattcaaaactttttaaaaaaaa

SEQ ID NO: 1265 - DNA, 453 bp, Nicotiana tabacum
ttttacctaatctttttttataaacagaaccataactgttctgtacaaatgcttatcatgtacatgagtgaaggtagactttaatctagtaggaaagaaaatcatcaactgtcaacacctgtcatcaattgtcaactcctcagaccaactactgcattggcagcaggaagagggcttacacctcgatcatacattcgctggatctcctctctgtactcggtcaatgacttatgtggtatagctggagttaattctataacatctcccattcttagcttgcagttgggatcactgactggttcatggttcaatcttggccttagctcttctttcagtggaaatccatagggtgtccatctagaactgccgcgaccagctctctccaaaagatccttgacagttgagtttgcagggaattcttgcacagacatcttatcgttgtcaatcataatg

SEQ ID NO: 1266 - DNA, 331 bp, Nicotiana tabacum
tggacgttcaccttgtcgagaatgaccattcatgtaactccgtagctgcatcttacccagtgcattctcgggcctatccttgaatacccacatgtacatattctccatatcatgctgaaccatgaaaacgtcgagctgtagatcagatttatcaaacccggaaaccccattactatctcggaccatctttggcttagatttctcatttaaaacaggcttaaagtaaaagctaaagaaaaaccaagcgccccagatgctatctactcgtttcacacatttcctcccaactttaggcacactaagaaatgtttcaggttcatagatctgagtt

SEQ ID NO: 1267 - DNA, 340 bp, Nicotiana tabacum
ttttagtaagtaattatattaatcaaagaacaaatttacatcgctgttgactcatcaccttggttcactttgtttattcatcaaaacacatacatatacacacctccataataccaccaaaaacaaatgtaaaacaagtagataacagtaaatccaccccttgctacaccattggattattatccactgggtaagaagataacatcacatagcatagtactggtatttatttaattttccttaacacatgacaaagcttttattcattatttgatcacgtaaaccgttattactagacatcagttggaagttccaacttggaatcaaagggatgttgctc

SEQ ID NO: 1268 - DNA, 422 bp, Nicotiana tabacum
agcaacggaagcgcccaaatcagacttacagttgttagttttgaactgataattctgttaggaagcttatcttgttagaggaaattatgatggaaatcaattcagaagtaaaagaaagctccttaattttgattaagcaaggtgccgaggctagagtctttgagacatcttttgtgggaaagaggtgtatagttaaggaacggttctcaaaaaaatataggcatccaattttggacacaaagctcactctcaaacgattaaatgcggaggcccgatgcatgactaaagctaggaagctaggggttttaactccagttctttatgctgttgatgctatatcgcattctctgacatttgaatatgtggaaggcccttcggccccggccgccgaagggcgaattctgcagatatccatcacactg

SEQ ID NO: 1269 - DNA, 144 bp, Nicotiana tabacum
ccatactactactatactatcttttatgatcgtatgtgataataacccaaagttcacccttttttctcgctttatatattccaaatactctgtcatttaaatctcttcaaatctaaaactgagtttaattttgggcaaccaaaa

SEQ ID NO: 1270 - DNA, 390 bp, Nicotiana tabacum
ttttgtcaatcttaatcccttgaaagagatcaaccttcaagttttggttgaagaaactggcatctttaaacaagtgcaaattacatgcaaccacaatggaaaaaagaaagctagtgcagattgtatcttattgatcccaaattggtagcccacatccataggcgaacgtcatgccagagaagatgtaaggaagtcaacatttacaagattaagggttctcaactcaagacatctttaaactgcaaacataaccctttcagtcaccatccatttatctgtcgtcatcatctagtaacctccttgtatgaaggcattcaaccggttcagctcttccctgtgctcactcacgacagcacggacaacatctccaatggacaccatccctatcat

SEQ ID NO: 1271 - DNA, 343 bp, Nicotiana tabacum
agtcaagacgccccctccttcctcttctcgccgctactttccattgatcgaattttgacttagtaaaagcgatcgaagaagaagatgtttggaaggacaccgaagaagagcgatagcacaaagtattatgagatcttaggagttccgaagagtgcttctcaggatgatctcaaaaaggcttatcgtaaagccgccatcaaaaaccatcccgacaagggaggcgatcctgaaaagtttaaagagcttgcccaagcttatgaggttttaagtgacccggagaagcgtgatatatatgatcagtatggtgaggacgctctcaaggaaggaatgggtggtggagggg

SEQ ID NO: 1272 - DNA, 332 bp, Nicotiana tabacum
tacaaagccacttccagcagaagcttataggagctgtgtaatctataagatatttaacttaacgacaacattgaaccatacatctaatgtaagatgcttagccaaggcctattaagagaaagcaatgtgcacgcagggtgttaaaagagtggaacagccttttaccctgggatttaaacctcgtgcacatgtaataggctaatagcagaagttgtaaattaagatattttatcaatgtctttcatgcgtaaaataatctccaagcacaagttcatatttgtcaccagcgttccctgggggcgccatctgaataaccaggaatcaaattcttt

SEQ ID NO: 1273 - DNA, 421 bp, Nicotiana tabacum
ttttaggagcaaactaagagagagtctcatttatacaaaggttaatccccaaaatgagtagtacaaaataaagagaaaaaaagggctaaagagacaatcttcccatctaggaacctcaagtcaatttacaaagctgaggtccatttagaagatgaaaatgcttgaaacacaattaataaaacagcagcaattaacaaagataacaagtctttgttaatatagtctttttttttaatgaggtctaaaccttgtatactggccccaatttgcccaatttgctgcacttccaactcttggcatgctattcacttttgagtagacatcaaccttgaaataagctccacacattgatccttcactatctactcttggcattgctttcatcttgtaacttggatgctcatagctctttaatcctgtt

SEQ ID NO: 1274 - DNA, 271 bp, Nicotiana tabacum
ttttacatcggcaggtaacactttctcacattacccccgaattaataatttagcacttaaaattgagaaagtcatggcattcgtgatcataaaaaacaaaataaattaaaaatgacttagaattaattaaataaattagtggaaataaatgggctttgtggaaataaaacaaataaaaataaaaataaataaacaaataaataaattaataatacggtatttacaaggaattggtttttgagctaaataagattgaaaaaaatcaattact

SEQ ID NO: 1275 - DNA, 78 bp, Nicotiana tabacum
aatctcaaggcaactgagctcaggctcgggctccctgggtccctctctcccgaaaggggcatagagacttgccctttg

SEQ ID NO: 1276 - DNA, 231 bp, Nicotiana tabacum
  modified_base (22)..(22): a, c, g or t
  modified_base (212)..(212): a, c, g or t
ttttgccacaaaattttggaanaatccttccttatgataacacatttttgcagaagcaaaagggccacaacaatacacttctatgactccaagtcacaattcaaacatcacttgtacaatgaacctaaggtttcctatagaaacaacgagaaactaatagcttctctaattcaaacatcagtgctaccatggcgctctaatgtttcccacanaaacactatgagaaaccta

SEQ ID NO: 1277 - DNA, 369 bp, Nicotiana tabacum
ttttcgaaaaacaaaaagcataaactatttgggacgaagaaatatattattagtagaaaaataaaattggagaacacaatttattgtttatttatttatgtcatagttcacatatctgttgccttattataagtagtatacttgacaaacacaattacgtaatccatcacttcatctcttgagatgacactccccatgtttgtgaagctgtacgagaaagtccccaattttgatcccctgcaacgtgccatgcaaagtaacctagcaatcctctacctttaacataattaaccttatttctaacactttgagtatcatcatagctaatccaattacttccagagtaacaataatctccaacaatagtag

SEQ ID NO: 1278 - DNA, 195 bp, Nicotiana tabacum
ctattttgaccattgacgatggcagagagtggtagtagtggagaggagtcaaagaagctgcagctctactcatattggcggagctcatgtgcatttcgtgtccgcatagctctcaatttgaaaggagtggaatatgagtacaaagctgttaacttgctcaaaggagaacaaaccaattctgaatacttgaagctg

SEQ ID NO: 1279 - DNA, 346 bp, Nicotiana tabacum
aatataacatttcacaaatgatctcaagcgtggtcatagaccttattacaagcagaatccacacgactcttgtggctgggaattatttagactatttaattttacgaaggttaccactaacacttatagtctagtggtactgacagaattttcacgcagtaggtgcagattcaattctcactattcccctccccctatgtaacaataatgttttttctttaaataaaaaaaacacagtagacatgtttgcaagctcacaagtattttcttccagaaaatcagtagctcattgggtggtggattttaaggcattttgcctatagattttgagctttgacagcagcat

SEQ ID NO: 1280 - DNA, 372 bp, Nicotiana tabacum
tcaaatcatttccgatcaataagtgttagttccatacctcaaagaagcattctttttaatgtccacctaaaattctccttccaattacaaatgatatattcttcagtggctcatacctgtgaaaagttttgactcgaacatatttttcatggagccgtggaactgtattatctactctattatgtgcacaacatatgattcttgccttgtcaaattgaactgcatttatgcacttctacagctaaatccaattgatcactgctggccttccatttcaatgacccgttttatatgaagggcagctctcacaacgtttccccttgttattattcccaccagtttaccttcactatcaacaacaggaagccgtcg

SEQ ID NO: 1281 - DNA, 353 bp, Nicotiana tabacum
atttctcctatagtcatgggatttgttctcttttcacaattgccttcatttcttcttgtctctacacttctcttattcctagtaatatcccactcttgccgtgcccaaaattctcaacaagactatttggatgcccataacacagctcgtgcagatgtaggtgtagaacctttgacctgggacgaccaggtagcagcctatgcgcaaaaattattgcttcccaatttggctgcagattgtaacctcgtacattctcatggtcaatacggcgaaaacctagctgagggaagtggcgatttcatgacggctgctaaggccgttgagatgtgggtcgatgagaaacagtattatga

SEQ ID NO: 1282 - DNA, 483 bp, Nicotiana tabacum
catttataagtatcacaagagaacaaaagatggtagatctggtagacaaactgggaaaaactatcgatttttcgagcaattagaacttttggacaaccagattaataggatggatacaacaacattaatttcaatgccagtaccaatgcctatgccgatgacaatgataaaaccagctactagtggatgtcaagatttcagttatcgaaaccaaggtttcaatttcaatccggagttcatgtctacgtccacgtccacaaactcttcctcgggtaaggaatccgatggtagtgtgaagaagaaaaggaaattggctggttattttgagaggttgatgaagcaagtgttggacaagcaagaggatttgcaaaacaagttcttggaagcgatagaaaaatgcgagagggatcggatagcgagggaagaagcttggaagatgcaggaaatatcaagattaaagaaagaaaaagaagcactagccca

SEQ ID NO: 1283 - DNA, 424 bp, Nicotiana tabacum
accaaaaaattccaagaaaaaatggcacattcttgcatagccacaacttcatccgtctcaaaattcaagtacccgattgaatcttccactcttcccctagcccaccccgtttccctccctcttaaacatcttcccttcaggaaattaaagactgttgggaaagtgaagaataggggaaatagcacggtgaaatccgtgtattccggagctgagtgggtttcggctaagccttcacctacaggaatttggtctataagagatgatttgcaagttccgtcttcaccttattttcctacatatgcccaaggtcaaggaccacctccgatggtacaagagagatttcagagtgtgatcagccagctcttccaatataagatcatacgatgcggtggagcagttgatgatgatatggctaatatcatag

SEQ ID NO: 1284 - DNA, 489 bp, Nicotiana tabacum
atcgccatgagtgctcatcacccgtgattcgttgtgatctgaagcctagtaacgtcttgttggatgacaatatggttgcccgccttagcaactttggtatttcaaaactgctcggtgaagatgagactgatttgttcactaaaaccttagcaacattgggctatattgtaccagagtatggactggctggattggtgtcaacaaaatctgatgtctatagttacggaatcatgttgttggaaaattttacaagaaggaagcctaatgatgaaatgttcgatggtgatcttaacctgaagcaatgggtgagttattcaatcccagaggcagtaatggatgttgtagatgccaacttgttaacaccaatggataatcacttaaacaagaagctagattgtgtggcatcgatcatgaaagtggcactagattgcagtgctgaatctgctgcaagaaggatcgacatgaaaaatattgtagggatgctaaaga

SEQ ID NO: 1285 - DNA, 261 bp, Nicotiana tabacum
catgcatacctcaggcggtgttggaagccagagctaaggaagctgaggcggatgctgagaaacagaaaaggaaacttgagagagatctggagaatgagaacggaggtgcaggtgtttactctgccagcttgaggaagcactatctattagcaaatgaagagtggaaggaagatgttatgccagaaattttagatgggcacaatgtctatgactttattgaccctgatatcttacaaaggcttgaagaattggagagagaag

SEQ ID NO: 1286 - DNA, 484 bp, Nicotiana tabacum
gtttcaagagaattaaagtgatctgaaaatggcttccaatggaaacaatcatgtatcaacaaaaccaccaccagagccttcaccattgcgaaaggcaaaatttttccaggctaacatgaggattctggtgactggtggtgctggatttattggctctcaccttgttgacaaattgatggaaaatgagaagaatgaggtggttgttgtcgataattactttactggatcaaaggataatctaaagcaatggattggtcatccaagatttgagctaattcgccatgatgttactgagccattgttgattgaagttgaccgaatttatcaccttgcttgccctgcttcccctattttttacaagtataatcctgttaagacaattaagacaaatgtacttggaacaatgaacatgttgggacttgccaagcgaactggggcaaggattttactcacatcgacttctgaggtttatggagatccactc

SEQ ID NO: 1287 - DNA, 421 bp, Nicotiana tabacum
aaagggtataaactcaaagtccctacctttgtaatccacactagactttatgaatctttcaggcataaactccagtggcttatcccaggattttggatctcttccaattgcccaagcattcacgagaacttgagtgttcttaggcacagtgtagcccaacacttgtatatcattttgggctttgtgtggcaagagtaatgaaactgccggatgaagtctcattgcttcttttacaactgcttgaaggtatggaagtttctcaatgtctgattctttcactggtctttctgtgcctatttgttgaagtatttcttctcttactttgttaagtacttgaggttttcgaagaagttctgccattgcccattctgttgttatagcagatgtgtcacttccagcaatgaataaatccaccataaga

SEQ ID NO: 1288 - DNA, 515 bp, Nicotiana tabacum
gaacaaaagctggagctccaccgcggtggcggccgctctagaactagtggatcccccgggctgcaggaattcggcacgagggggatcttttctcttttcacaaatgccctcattttttcttgtctctacacttctcttattcctaataatatctcactcttctcatgcccaaaactctcaacaagactatttggatgcccataacacagctcgtgcagatgtaggcgtggaaccattaacttgggacaacggggtagcagcctatgcacaaaattatgtttctcaattggctgcagactgcaacctcgtacattctcatggccaatacggcgaaaacctagctcagggaagtggcgattttatgacggctgctaaggccgtcgagatgtgggtcgatgagaaacagtactatgaccatgactcaaatacttgtgcacaaggacaggtgtgtggacactatactcaggtggtttggcgtaactcggttcgtgttggatgtgctagggttaagtgca

SEQ ID NO: 1289 - DNA, 490 bp, Nicotiana tabacum
cttcaaccaagttgttatatttgtcaagagtgtaaatcgggcagcacagctggataaattactagtggagtgtaattttccatctatctgcatccactctggcatgacgcaggaagaaagattgactcgctacaagggtttcaaggagggtcacaagagaattcttgtcgcaactgatctggttggtaggggcattgacatcgaaagggtcaacattgttattaactatgacatgccaggttctgcagacacttatcttcacagagtgggtcgagctggtaggtttggaactaaaggccttgccatcacatttgtgtcatctgcatcagattctgatgttctaaatcaggttcaagaaaggtttgaaatagacataaaagagcttcctgagcagattgatacttctacatacatgccatcttagcgatctcgagagcttccagcaatatcaagtcatttcggctaaaagatggggggacctgacaggtgt

SEQ ID NO: 1290 - DNA, 431 bp, Nicotiana tabacum
ttttagaaaaaaatttaacttttatatattatcagtgtaaaagaactttctgacattatagacaatactgttaacttttacaatcttgtaattggaggatagagttggccttcaaattttacatggtcctagcaacattattggcttccccttccttattcttaagtagttgcatgacatcttcaataagcaatttggtattcaagaacgaagatccttcttcttttattaccattttcgacatgtgtgccaactcctttgttctttttcttctttcttcaccctctaatcctttatccattagttgatctattgcttttttcacttgatccttattaaccaacactccattcttctcttcattccaagaattaatactcacttcaaccccaactcgaaccccaatcttcaaaacatttacaatgaatttc

SEQ ID NO: 1291 - DNA, 530 bp, Nicotiana tabacum
ttttcctagtcagttcactggttacagttaccttgtaatcctgcatggctcattaaggttgttaaatatacttttaatttcctgatttgagaaagaatttttttttatagtggctttacttgcacaacttgataaaaaagaacactacattttctgtatggataaacgtgtgaacaagttaggtgctgacacttcagcttcccatttccttggacctagactaggttttggttcaacatagcagaaggttggtcaagacgacaaaaaggggaggggtgaatagaaaagatatcttaggtgtatcactcgtccttagaacactgccaacccaattatatatgtccctgtgtgtgactgttcaatttttagacgattagaaatgcttttagtacaatttatcagtttgacctcttatggtttgctccttttgttcgtgtgttactcatccgtctctaaggtctcactctaggttaaagtttacaggtaaggagtttgatgcatatgcaaaagttgttgttaatgctgctggg

SEQ ID NO: 1292 - DNA, 163 bp, Nicotiana tabacum
ttttgataaaatcctgaatacagaattataaagtttgtccaatcaacaagttatacagaggaagtttagcagaaaaagtggaaacaaaagacataaattaacatcctaatacatccacagctaatcaaaaccgaaacaaacagagtacacaataatcactaga

SEQ ID NO: 1293 - DNA, 452 bp, Nicotiana tabacum
tagtcagttctagcctccttttccttagaaataatggattatcatatttctttccattttcaagctcttttagggcttttagcctttgtgttcttgtctattatcttatggagaagaacactcacttcaagaaaattagcccctgaaatcccaggggcatggcctattataggccatcttcgtcagctgagtggtactgataagaatatcccatttccccgaatattgggcgctttggcagataaatatggacctgtcttcacactgagaatagggatgtacccctatttgattgtcaacaattgggaagcagctaaggattgtctcacaacgcatgataaggacttcgctgcccgaccaacttctatggctggtgaaagcatcgggtacaagtatgcgaggtttacttatgctaattttggtccttattataaccaagtgcgcaaactagc

SEQ ID NO: 1294 - DNA, 272 bp, Nicotiana tabacum
tgttattttcctattattattatttgttacagtatttaaacaatctaacaaaaccttcatggccatgaaatttttttcacctttttttcgaaatcagtgtttggcgataaaattttcaattttcacttgaagatgaattttaaaatttttcgaaaatttgaaaaactccaaaaaaccttttttcaaaattttaactcagatcacttacaaaaattaaaaacaacccaaaattatattcatgtccaaacacaactctaatttttaaataccat

SEQ ID NO: 1295 - DNA, 437 bp, Nicotiana tabacum
tcagaaccttttttaattgaaattggtgacaggacgaagattacggcaggctgtaaattcaccaaccatgatggtgcaatgtacgtgatccgaagcatggaaaagtatgaagatgcccggaattttggcagaataaaactcggaaagaattgttttgtaggaaataactgtatttttcttcccggctcacaaatgggcgacaattgtattttgggcgcaggatctgtactgaattccagtatgcccaataattccgtttatgcgggaacccctgcaaaattcatttgtactgttgaagaatacggcgataaagctttggaaaataatgtaatgtaccccagagaactggaacccgacagagcaaagcttgaagcatatattaaagaacacatccctcatgtttacaaacccgtaaaaaaataaatggctgaaaaaaa

SEQ ID NO: 1296 - DNA, 454 bp, Nicotiana tabacum
cattgagggattgatcagaacgtaaataaaatgaagattcggattgatacattttgcccaaatctgaaatgtggaaagccattttccactttctctgtaaaaatctttctgaagagtagaatagtgatctgccatataacaaaggtagtaaatcttgtattttaagttgaatttaattataatccgtctaaaattgaagtaattttgttcacggaattttcaagattgaaaggcatttcataatctttcagcttctccgaatatttatcaaaaaattcaggttgagataatgcttttttcattccgtcataaattccttcatccgagttttcaacaattaaccccaattctccattattcagcatttcgttcgctccggaaacttcagtggaaataattttctttttcagggtgattgcttcaaagagaacggttgggaatccttcatatcttg

SEQ ID NO: 1297 - DNA, 345 bp, Nicotiana tabacum
attgatcagaacgctttggatttggattaatcatctcaggctccttaccagtacagggcaacaaacaggattactatggtggcaaccacagttaccgcccagagacttttgataattggctctggtcccattttttcgtcttttacaatgatattggccgctttcggtgccagttcaaaccaggttttggtgtgcagcagagctgccgccagagtgatcaggttaatgatcaccgataaccgggttttgtaaaaaggtcgacgaatcccgcccaggcttccgggccatttttcagggcaaacagcccgaaaatcagttcaatgctgaaccacacagccggaaccg

SEQ ID NO: 1298 - DNA, 447 bp, Nicotiana tabacum
gatcagaacatagattttcaggccacaaagcaattttgtcaggtcctgctggtggtgtagttggttactctcagacactctttgggattgaaacagacaaggccctaatcggttttgacatgggtggtacctctactgatgtcagccgatatgctggtacctatgaacaagttatagaaacccaggttgctggtgcaataattcaagcacctcagctcgatgtaaacacagtcgctgctggcggtggatcaaagttaaaatttcagtttggttctttccgggtgggaccagattcagtgggtgcacacccaggaccagtttgttaccggaaaggcgggcaactagcagttacagatgcaaatcttatcttaggatatgtcattcctgattttttcccgtccatttttggtcccaatgaggaccagccattagacattgatgctacga

SEQ ID NO: 1299 - DNA, 604 bp, Nicotiana tabacum
attgatcagaacaagggtaacgaagaagtttggtgattccttcttcttgaaaagttcccttctcaacaagcttgaatgcttttattgctgctccttcctcccatatgaactttgagaaaggcggcatacttccaggagtaatacctccaatctctgcatgatgccctctacttgcaacaaagaatatcaatctacctttgttaaaaacaggtgtaattacagttatatcaggcaggtggctaccaccagcagaagggtgattggcaactaaaacatctccctcatttagattatcaccccagtgcttcagctgccaccgaacagtgctcgacatagcccccaagtgcacaggaacatggggtgcatttgccacaagcccaccatcagggccaaaaagtgcgcaagaaaagtctagccgctctttaatatttgttgatatagaagtcctctgcaaggtgcgccccatctgttcagctattcccataaaccggttgttgaaaattgagagctgcacaacatctgcaactttttcatctacttttgcagtattggaagccgactcgatctctattttaatgttgccatattttgtaataatggcctg

SEQ ID NO: 1300 - DNA, 481 bp, Nicotiana tabacum
gaaacccgcattaaaggtctgttcgccgtgggtgaatgttcctctgttggtctgcacggtgcaaaccgtctgggttctaactccctggcggaactggtggtcttcggccgtctggccggtgaacaagcgacagagcgtgcagcaactgccggtaatggcaacgaagcggcaattgaagcgcaggcagctggcgttgaacaacgtctgaaagatctggttaaccaggatggcggcgaaaactgggcgaagatccgcgacgaaatgggcctggctatggaagaaggctgcggtatctaccgtacgccggaactgatgcagaaaaccatcgacaagctggcagagctgcaggaacgcttcaagcgcgtgcgcatcaccgacacttccagcgtgttcaacaccgacctgctctacaccattgaactgggccacggtctgaacgttgctgaatgtatggcgcactccgcaatggcacgtaaagagt

SEQ ID NO: 1301 - DNA, 484 bp, Nicotiana tabacum
gcgaggctttgtgcttctctggagtgcgacaggtttgatgacaaaaaattagcgcaagaagacaaaaatcaccttgcgctaatgctctgttacaggtcactaataccatctaagtagttgattcatagtgactgcatatgttgtgttttacagtattatgtagtctgttttttatgcaaaatctaatttaatatattgatatttatatcattttacgtttctcgttcagcttttttatactaagttggcattataaaaaagcattgcttatcaatttgttgcaacgaacaggtcactatcagtcaaaataaaatcattatttgatttcaattttgtcccactccctgcctctgtcatcacgatactgtgatgccatggtgtccgacttatgcccgagaagatgttgagcaaacttatcgcttatctgcttctcatagagtcttgcagacaaactgcgcaactcgtgaaaggtaggcggatcccc

SEQ ID NO: 1302 - DNA, 543 bp, Nicotiana tabacum
cattgagggattgatcagaacgtaaataaaatgaagattcggattgatacattttgcccaaatctgaaatgtggaaagccattttccactttctctgtaaaaatctttctgaagagtagaatagtgatctgccatataacaaaggtagtaaatcttgtattttaagttgaatttaattataatccgtctaaaattgaagtaattttgttcacggaattttcaagattgaaaggcatttcataatctttcagcttctccgaatatttatcaaaaaattcaggttgagataatgcttttttcattccgtcataaattccttcatccgagttttcaacaattaaccccaattctccattattcagcatttcgttcgctccggaaacttcagtggaaataattttctttttcagggtgattgcttcaaagagaacggttgggaatccttcatatcttgagcttaaaatataaaaatccgcttttttgaagtatggataaggattatctgtaaaacccagcatggttgctgtttcatcaacaccaaga

SEQ ID NO: 1303 - DNA, 437 bp, Nicotiana tabacum
ccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcg

SEQ ID NO: 1304 - DNA, 534 bp, Nicotiana tabacum
cgcgacgcctgggtcatcttcctcctcgacggattcgacgacggggagtggctgttttttgaagaaatagtgttgtgttgattgtttaaaagcgggcgtttcagcctctacagtgacttcggcttttactatccaaagcacccatagctgcctggcatacccaccaaccagcaccattcctgcaaaccacaggcaaatcagtaataaacaaattacatatattatggtgctgtgtttttgtcgggagaagataccagggtgacctgtttctttctgctcacgcgcggcgatatagaattcaaacatgtcatttccccttcactgttgtttccggggaaatatttgcttcatcccgatataagtaggcactctcccctgccacctgccagagatgtactaacgttgaaaagccaacaacaccgtcagttttcaagtggtggcttttttgaaattgctttattttttctaccaacaagggacgccactccgccgaaggttctgtcgaaatatgcaatgcgcggtttaacatcgttt

SEQ ID NO: 1305 - DNA, 426 bp, Nicotiana tabacum
cagaactcgtacaaagtgaacaagcagtggctgcgttatgctggtcataccgccagtgatgaagtgtttgaaaaactgaccggcattaaaggtgcgttccgtactcgtattgcctacgttgttcagaccaacggcggtcagttcccgtatgaactgcgcgtatctgactatgacggttacaaccagtttgtcgttcaccgttcaccgcagccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagtctgaacctgtacgta

SEQ ID NO: 1306 - DNA, 405 bp, Nicotiana tabacum
acaccttgccgatcagccaaacgtctcttcaggccactgactagcgataactttccccacaacggaacaactctcattgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggcttttttggttgtgcttacccatctctccgcatcacctttggtaaaggttctaagctcaggtgagaacatccctgcctgaacatgaga

SEQ ID NO: 1307 - DNA, 507 bp, Nicotiana tabacum
tgattccatttgcgccaaaccctcgcttagcacagcgaagaagaaggaataataatgaaaatggaaagtatggtgtgacaggtctatgagtcaaaatcctaacgatccaaatgaacagaaaaaaagcaaccctttaaaagacgcaacttcccattttattaagataaaaagggatgaaagcaagcgggaaaatggcaaaaatggcaggaaaagcaggaagggcggcagcgaaagctgctgccaaactgctaagagctggtgtagtgaaaattgtgggatgctattgtgggatgccgtaggattacctgttgctctcattatggctcttattattactgtatgtgttattttagcatcttttgtaccatttaccgatgatgaaagtaaaacagaagaacaagtgaaaaagtatatggaaatttcaatggcgctaaacgtagactggaaagaggttgtcgcttttgacatggcgcggtttgataaatgactggactggtaaaagatccg

SEQ ID NO: 1308 - DNA, 479 bp, Nicotiana tabacum
gaacaagcagtggctgcgttatgctggtcataccgccagtgatgaagtgtttgaaaaactgaccggcattaaaggtgcgttccgtactcgtattgcctacgttgttcagaccaacggcggtcagttcccgtacgaactgcgcgtatctgactatgacggttacaaccagtttgtcgttcaccgttcaccgcagccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagtctgaacctgtacgtaatggatttggcttctggtcagatccgccaggtgactgatggtcgcagtaacaatatccgaaccgacctgg

SEQ ID NO: 1309 - DNA, 348 bp, Nicotiana tabacum
acgctcggttgccgccgggcgttttttattggtgagaatcgcagcaacttgtcgcgccaatcgagccatgtcgtcgtcaacgaccccccattcaagaacagcaagcagcattgagaactttggaatccagtccctcttccacctgctgatctgcgacttatcaacgcccacagcttccgctgtcttctcagttccaagcattgcgattttgttaagcaacgcactctcgattcgtagagcctcgttgcgtttgtttgcacgaaccatatgtaagtatttccttagataacaattgattgaatgtatgcaaataaatgcatacaccataggtgtggtttaatttgatgc

SEQ ID NO: 1310 - DNA, 314 bp, Nicotiana tabacum
cagaaccgggccatgttaaacaccctgaatgttggtccaaccctggatccgcgttttcagacctatcgctatttgcgtacgccggaagaaccggtaaaacgcgatagcccacgtcgtgccttcctgatgattatgtggggcattgtcggggggctgatcggggctggtgtcgcattaacccgccgttgctcgaaatagcaacactgctgcggtgagcgcaaaggcgctcgccgcttattcgaagagaatcgatgtgaaagtactgactgtatttggtacgcgccccggaagccatcaagatggcgccgttggtg

SEQ ID NO: 1311 - DNA, 324 bp, Nicotiana tabacum
ttttaaaaacgataatccaaatgcattcttgatctatataacatctagacaaaagtacatgtgactcttattcatgtcttatgtttattacagcaaagatcatctcttgaccacttcaaccaaaataaacaaagtgtgtaaactataaaagcgagacaaaataaattgtcccacactaacgctttcacgcaataattcgaccaaagatgatcttattagaggaatgaccgttctacttagccacttcatcacttccaggcatttccaaggggaaatttgggtgagcttgaccattaggacagaagataaccttataatttgtac

SEQ ID NO: 1312 - DNA, 302 bp, Nicotiana tabacum
gtgaattttgtaggaaaaagaagaagaagaagaagaagaagaagaaagagagagatggtgatggaagaaggatgtcaaacaccaagaagcccagaagcaaaggtaggtatgcaagtggaagatctatgggatgtacaagaaccacagcttagtcctactgagaagctcaacgcttgtttcgagaacattcctgtttctgattttcctcctgctccttctaatcaagtaattgagataagatcagatgcaactttggccgaagctgttaagttactatcgcggcacaaaatactaagtgcacc

SEQ ID NO: 1313 - DNA, 305 bp, Nicotiana tabacum
tcgtagcacttttcaactcagaactcatattttggaagatgcacaaggtgttatttctgttgttaagatgaacttccctcaatgacaatgttggttgatattcacggccacttttcgactgtgcaatattatcttcagtataatctggaacatggtagctttaccattgcaaaagatagtttcttaacatgtatttgttcagcattctttgctcttcttcagagtgcagaccatgcttttgacccaataattatgtttgtttcatagcctctcttaggtaagtaggatttgcttttatcctaaaa

SEQ ID NO: 1314 - DNA, 301 bp, Nicotiana tabacum
gggcatttggagataatgaccctgttgatgttgttgagattggggaaagccgtgctaaagttggccaggtcttgaaggtcaaacctttagctgctttggcaatgattgatgaaggagaacttgactggaaaatagttgctatttccctagatgattcccgagcgtcacttgtcaatgatattgatgatgtggagaaacattttccgggcactctgacagctatcagggactggtttagagactataagatccctgacggaaagcctgctaacaagtttggacttggaaacaagccagctaa

SEQ ID NO: 1315 - DNA, 387 bp, Nicotiana tabacum
ctggctgatcttcaaaaggacgatggatcaggctttcaggaagatcaggttgagagcagaggatgtacaaggaaagaatgtcctcacaaacttctggggaatggacttcacaacagacaagctgaggtcactggttcgcaaatggcagactctgattgaggcccatgtggatgtcaagacaacagacagctataccctgaggatgttctgcattgcttttacaaagaaacgcccaaaccagcagaaacgtacctgttatgctcaaagcagccagatccgtcagatccgtaggaagatggttgagatcatgaggaaccaagcaagttcatgtgacctgaaggagttggttgccaaattcatccctgaatcaattggcagagagattgg

SEQ ID NO: 1316 - DNA, 529 bp, Nicotiana tabacum
gttcaccccattacagactgcatctttaggcttttctgccctaaaccaacaagatttaagcaaatctaagtgaaccagcaaggacaaaaacaggtatgtcgtcttcggaaaatccagagattgttgagagggttttcgggaacaaggagaaggaggagaaagaagacaagaaagatgagcaaaagggtgggtttattgaaaaagttaaggactttatccaagatattggtgagaaaatcgaagaaacaattggttttggaaaaccaactgcagacgtaactgaaattcatattcctcatatcaatcttaaaaaagctggaatagtcgttgatgtgcttgtgaagaatccaaacccccgtcccaattcctctcattgacataaactatttaattgatagtgatggaaggaaactggttactggattaatccccgatgctggaacaatccatgccatggtccagagactggtcaaaataccagtttaatcggtttaatgaatgacattcaaaaaattacattaccacgata

SEQ ID NO: 1317 - DNA, 277 bp, Nicotiana tabacum
cacttgagaaaactggcgagattcctataccttgcaagccagatattgatcttgagaaaatccattttgagaggttctctttcgaggaaactgtagcagttcttaagttgaagctggaaaacaagaacaattttgatcttgcgctcaatagccttgattatgatctttggctatccgacgtcaatgttggcggtgcagagctggagaaatcagctaaacttgaaaagaacggaatcagctatattgatatccccataaccttcaggccgaaggactt

SEQ ID NO: 1318 - DNA, 258 bp, Nicotiana tabacum
cgaagatggtttttctattaacttgcttttctttctgttttggggaggagccacgagcagtgaatgggttgtgaactatgcataatatgccagttttgccagtttatatatatattaatatacatgtaggtatatgatagtagctacataactttgaatatgatcttagttctcattgtaacatagtccatttttcttgttcatgtgtaatatgtataaaaggtcttttgggaatggatccgatttaacttctttcat

SEQ ID NO: 1319 - DNA, 296 bp, Nicotiana tabacum
gagaaatttggcaactttagcatagaagcagagtgtcctaagattgtggaatgggcaaaaaagtgtgtgcaaaaggagagtgtctcaaagtctcttgctgaccctgacaaagtctatgattatattgtgatggcgagacaaaagtggggcattgcctaaaacaaaaaagacggatctagagtgggttctgcaatcaagtgaacttgtttcttgttcgaactatgtattcatatacaaagattttaaaaagtatacatatagtaataagtttcctttttactttcctttgaaatgga

SEQ ID NO: 1320 - DNA, 419 bp, Nicotiana tabacum
cgaaacattccccaaattaaccaaacgaagaacacatcggtagctgacgtctggaccggcggaatcacagttgctgttggttgttcaatcgttggagcaagtgtcttccaatcaacatcatgagaaaaccaatacttgatcgtcttattgacgctgggattggtactatagcaaagtgtataacttctagcctgagaagaaaagatggcatcttgcaccaccccgagttcaatcaatccattgccgaatatggtcagacattcacccgtaagcgtgttaacgaggaagatgcaatgctgataggtgtcgatgttttcgtccgttatacggtgataggttctggagttgtcgctttcatctatcttgtgaaaagtcatttcaactggctgaatcaaagtaagttggagatggagcgacgc

SEQ ID NO: 1321 - DNA, 404 bp, Nicotiana tabacum
agggtcgtctttgacacattcgagccaaaaacaataagtttagctgacctcacagaactaagttgagatccacgtctcaatataatctatagataatttttagggataagataaagttcgtttttcttatgcatggtaattccaggcctggcgtttgtgtcaatgtcttcttttttcattcccaaaggtaactcccaatcaaatgcataaagaagatttgacaatgcaagttccattgatgcaaccccaagtgcaatacctgggcaacctcttctgcctgcaccaaatggaattaactcaaaatctttacccttgtaatcgatattgctattcaagaatctctcaggtataaattcttctggattttcccatatttcaggatccctcgcaatagcccaagcgtt

SEQ ID NO: 1322 - DNA, 284 bp, Nicotiana tabacum
cttattttccttctttctaaatccaagaatggtggaaaaaccacactgccaccagaatgtgttggttgcaggatcagacactagtgcagctgctactgtttgggcaatgacagccttgataaaaaatccaaaaaccatgaaaaaagttcaatcagaaatcagaaaatcaatagggaagaaaggaattgtaaatgaagaagatgtccaaaacatgccttatctcaaagcagtgataaaggaaatatttagattgtatccaccagttccacttctagttccaagag

SEQ ID NO: 1323 - DNA, 572 bp, Nicotiana tabacum
ttttagacaaagaactacgtagaggctgcaatcagattatgagttgcaactatacaatggattttgggtgtaaattataaccccaaatccatgtgatacatctatttcgaatcatacacaaaactgttgaataattacatggaatacaataacaagcaaaagggaggctgcatgtaccgaaaacaggaaagaaaatcccctttgaagccacaaaatttattgctttgggaatcttcctcttatctatggtgactaaatgtctccgaaacagaagctctaccccttagtctcatatctatagatagcctaacagaagatggaaggaatgcatggataagcttacgagagggagccatatgaggctcttctttcttatttctcctctgcctcgacgtcccagctgtagtttttgtacttctcaaagatcgtgattttggatcaaaatttgatgaagtaaaagaagcctcagctacattgaatgatacaggaccgttgtgtgatgcatcaagaggtatccgactgctccatcttgatgtggcggagatattctcactcttggctctttagcattg

SEQ ID NO: 1324 - DNA, 251 bp, Nicotiana tabacum
cagcagttctgttcgtggtggttgcattctgcttcttgattatgctttacaaattgatgttctcctggtttattgaggttctagtggttctgttctccattgggggtgttgagggtttacaaacttgtttggtcgctttgctatcatgtttcagatggtttgagcgttttggagagtccttcattaaaattccttttctggggcctgtttcatatctgacgccggcgatttctccattctgcattgtcttt

SEQ ID NO: 1325 - DNA, 271 bp, Nicotiana tabacum
tacggtggcggcggtggcggttacggaggtggccgccgtgatggtggttacggtggtggtggaggttatggaggtggccgtcgtgaaggtggttacggtggtggctctgaaggaagctggaggagtaaattttccgttgccttcagatcttttgttcgaaatttatggttctaagtttgttgaagttccgttatggttactgttgttcctgttactgtcctcgtttttgaccgcgagattgttaccgtgatgttacctttgtggatctgtt

SEQ ID NO: 1326 - DNA, 306 bp, Nicotiana tabacum
ccattgctagcaatggtggaagagttcaatgcatgcaggtgtggccaccaattaacaagaagaagtatgagacactctcataccttcctgatttgagccaggagcaattgcttagggaagttgattaccttttgaaaaatggatgggttccttgcttggaattcgagactgaggtcaacgtctattataaatcttgctactattatcaagcatatatacctaacatgaattactcaatcctaactaatttgggatcaaatgtagttgattaatggtatttatttcatgttaatgttttgtttaaaa

SEQ ID NO: 1327 - DNA, 162 bp, Nicotiana tabacum
attgggtttttgttattgggcttactttgggccttagtaatcttgcccaaaagggatatgaggcttgataaattctttggagttgggcttttggctatttactcttgcttcttgttcctaaaacttgctagagctttgggcttccttgaatttcaagtgtcc

SEQ ID NO: 1328 - DNA, 333 bp, Nicotiana tabacum
gataggacaaggaaattttataagagtgatatttataagaaatttagagaacaagctaaggctgctgagatggaaatggcagtgggacaaaatggaggtgttgttcaaagtaatacaactagtaagggatagattggaatgaagtaagaagacaaaatattgaagaaaaaaagaaatggagaaaagtcaaagagaaaagagagattagatagattttgttattatttgaaatatactacatggtataatatttataccatatagctttgtaagtgtgatggatcaatttaatggacatgaaatatagttttgatgttttctcttacatgtaaa

SEQ ID NO: 1329 - DNA, 331 bp, Nicotiana tabacum
atgggggtggagcttttatctgttgtgattgtgatgagcagggctatggatgggcttaccaatgccttgagtgtggctatgaggtacaccccaagtgtatcaagcccgtggcgcgtagcccgggcagctaattagttattgggctgatcttagcattcttacatgttatgtaggtaccagataaataggcaaagaatacaatatgttataattggtataaagtttgtcttactgataggttatggtgaatctttaatggtttctatttatgctcttttcaacttgtaattcttggttttagcagaaatcaaatatgagcctttgaagaaaa

SEQ ID NO: 1330 - DNA, 290 bp, Nicotiana tabacum
aattccacaacctttttcttcgctgtaagaaagaattggtgtttggcttggatttttgtggttcattagttgctaaattgacataatcacatggttcacagtcaccgctgatcttcgctcagaattcctttggcttctgcttcttcgttgtaacagaaaattagggttttgtttggggttttgtagttcagtagttcctcaattgacataatcatatggctgaaaggtacaactttcctatggcaagaaatactgaagctactgccaacgagtccaaaaatgaatctaag

SEQ ID NO: 1331 - DNA, 317 bp, Nicotiana tabacum
ctatctcaggccactatctctgtgcaaattgattttgggaagcgggcagacagagggatgacttcagggccatcaattgcaaaggataacgagaatcctccaccctctggtaatcaacatatggatcatttcggggaggcaaacaatgatgaagatttggaccaagctcaaaagaggctaaagatatagatatgataatagcatggtcatatccagctaaatcaacgtagttttttatgtcatcttgtggttcaaaagaaagtcgatatgtatatcccattcgttttttatcatccttgagtcatgtttatagcaaa

SEQ ID NO: 1332 - DNA, 553 bp, Nicotiana tabacum
ctaagaagaagggtaagggtaaaaataaacccaagaataactactgcgctaagggtggtgtgaccaaacccaaaggcaagacaggcaaaactgaccaatctgatgttgaatgtttccattgtaagaagataggacattggaagagaaactgcctggagtatcttgcaactctaaatgataagaaacaaggtaagactcaattggaaaatgttttcaaagtttctttaactactactgatgtttcattgtgagtattagatactggcagtggttataacatctgcaatatgttgcaggggttcgaaataagtagaaggttgaagaaaggagaaattaatctatacgttggaaatggtccaaaagttgcggccataactgtagggtcaatttctttaataatgcgtacgggcaaagtacttatgttggatgattgttattacgttcctaaatttatttcgaacataattttaacttttatgttagataaacgtggttttcacataaatatagacaatggtatttgctctatttattatggtgataatttataaaa

SEQ ID NO: 1333 - DNA, 257 bp, Nicotiana tabacum
tttaaagcacgttccggcgaacaagcacaaaagggaaactaccgatcaatcaattaaaccggcgatggagatgaaggaagggtctgtaattcatcaagtcctcgttaaacttctcgatgggaagcacaaaaccctaaatttcagtaccccatccatctcgaccctaaccctaaagcagaaaatccaagccctaacttcaatcccttgtcaccttcagctcctgctcctttccaattcattctaccccctacacgacg

SEQ ID NO: 1334 - DNA, 233 bp, Nicotiana tabacum
caatctagtaagcgttcaaaagaaagtggaaatccaaatggaaattataatcttcaggggtcctatgagcccagctctgagggtctggccggaaattttaacaaacccaaggagggcgaaacatcctattcgttaagaatgaaggatcatgaatccagccaagcaacacatgaccagatctccggatcaagtgacagtgaggaagtgggtgatgctcagactagagtggatgg

SEQ ID NO: 1335 - DNA, 388 bp, Nicotiana tabacum
tttccctgaggtaatacctctgctgctgctatgagcagatgtcacattcattaaaccgtgtttttagtcaataaatcgaactgatatatgtgatgcgtgtgtgtcgcttgtgcactcttagtctaatatacatatacataaatttacatatagagagagtgtcacgcgtaagagggaaataggctttaaagctcacttgcgcaaaaaataatgaagcattgtggataaatgctcaagcccctgcatgccaattgtttgtctactacttcttatgtccgataccaatcaatgtaagaatgttattatcaggccgcctccaatagaatccctgcaaaataactggtaggatgttgcacgatacaagaacgtagatcagcaatgcgtgagt

SEQ ID NO: 1336 - DNA, 435 bp, Nicotiana tabacum
ctaaaatggcgaaaaatgagagcttccaaggtgtgtcaacttgttatgttttcaaaagccgattgcaagaatatgcccagaaagttggatttcctacccctgtttatgagattatcaaagatggcccttctcataagcctacatttaggtcaacagtgattgtgaataatgtcagatatgattctctacctggatttttaaatcgcaagacagcggagcagtcagctgctgaagttgcactcaagcaacttgtagattctggggcagtggcattgtgcctttctcagccagtgcatcagacaggcttgtgcaaaaatatgttgcaagactatgctcagaagatgaattttgcaattccacaatatgaaatgcagtggcatgaaacaaaaggcaaaatcacatgttcattttcctgtactgttgagatagggggaa

SEQ ID NO: 1337 - DNA, 263 bp, Nicotiana tabacum
atggcaacaagtattgtttttgagcacgcgaatgatggttctggcattggcgctgcacttcttgcggcctctaactccctatatgttgaagacaagtcttgagagcgattagatgatatttagctagaggaaactccctttaccttttatatagtgcttttctctagcctttttcttttgatttctctcctttttggttcttctaccaattatattcagaattttccagcacttgtacttggtttatagtttaggatattata

SEQ ID NO: 1338 - DNA, 502 bp, Nicotiana tabacum
gagctactgaattaattccgtatatttagaagagtgaaaaagataaggagaaaaaaaagatggagaccttcccagtgattgacatggagatgcttaacactaaacaaagagctgcgacaatggagaaaataaaggatgcctgtgaaaattggggcttccttgagctggtgaatcatgggatatctcatgagcttatggacactgtggagaagctaacaaaggaacattacaagaagtgtatggaacaaagattcaaagaaatggtggcaaacaaaggacttgaggctgttcaggctgagactgatgatttggattgggaaagtactttcttcttgaaacatcttcctgtttcaaacatctcagatgttcctgatcttgttgatgattacaggaaggtgatgaaagaattcgcacaaaaactagagaaactagcagaggatcttttggacttgctatgtgagaaccttggccttgaacaaggttatctaaagaacgcttttta

SEQ ID NO: 1339 - DNA, 529 bp, Nicotiana tabacum
attttgcccaaatttcttttctttgcatctaaggttcgatttcattatggaagaagcaaatgttgttgaagcgaaggatggaactatctcagtagcctctgcatttgctggtcatcaagaagctgtacaggatagagaccacaaattcttgacacaagcagtcgaagaagcttacaaaggtgtagaatgtggacacggaggcccatttggtgcagttgttgttcgcaatgatgaagtagttgttagctgccacaacatggttttgaagtatactgaccctacagctcatgcagaagttacggcagtaagagaggcatgtagaaagctcaatcgatttgagctctcagattgtgagatatatgcttcttgtgaaccctgtccgatgtgctttggcgctatccatctatcacgtatcaagaggttggtatatggggccaaagctgaagctgcaattgctattgggttcgacgatttcatgcggatgctcttagagtactggattttatcagaaggctcaataagagatcca

SEQ ID NO: 1340 - DNA, 530 bp, Nicotiana tabacum
gaatgacccacattgtgagagatgtagaaaaacctggatcaaaactccacaagaaagaaacatgtgaagcggtcactataattgaaacacccccaatggtgatagttggtgttgttggatatgttacgacacctcgtggcctgcgttgcctcaacactgtttgggctcagcatctcagtgaagagttaaagaggaggttctacaagaattggtgcaagtccaagaagaaggcctttttgaagtactcgaagaaatacgagaccgatgaaggtaaaaaagatatccaggcgcagttggagaaactgaagaagtattcttcagtcattcgtgtgttggctcacactcagataaggaagatgaaaagtctgaaacagaagaaagcacatctgatggaaatccaggtgaatggtgggactattgcccaaaaggttgactatgcatatggtttctttgagaagcaggtgccagttgatgctattttccaaaaaggatgagatgaattgaacatcattggggtgtttacccaaagg

SEQ ID NO: 1341 - DNA, 367 bp, Nicotiana tabacum
aagaatccaaaactatttgaatgttgctttacatccctctctagagtgacaacatcaaaaaaattgtagctaacataaattttggattacgcagaagaagggtcagctgcttcagatgcagcggcagctcttttcttggcaaaatattcctcagctctagcaaggtttttggcaactgatggttttacccacttctttctgcccggtagaacggttaatgaacaaccagcagcctctagtttttcctttgctgatgttgaaaaggcgcgcgccttaaagttgagcttcacgcttagttcaccatcgcctaagatctttagcggaagtctcctttctctccctgatggatttattagacccttctgct

SEQ ID NO: 1342 - DNA, 386 bp, Nicotiana tabacum
acttgcatgtagttccgccagcaatgtacaatgagaatcccctctttttccctccgggttacggctttgatgctcagatggcatttggacagtcctcccccatcgctagtcctctttctccttttatgatagatggccagctatactccccacaccagattccggtttctccaaattactatgcaccacctatttcccctggcttgccgcatgttacatcagctcttccagcttcgcagcctgatctggtggcaccaggaagcactggccatgaaattgatagcatgtattttgggccaggatcaggttactacatacccgttggatcgtttggcggaggcgagctttcgggaagcagcaacattggtttctacaattaccaaggt

SEQ ID NO: 1343 - DNA, 547 bp, Nicotiana tabacum
ctcctctgggaaatggaaagcttgatgctgcttatcgtgaagcaaaagagaggaatgctgattgtcctgtttttctctttttctcggtgaatgctagtggacaattttgtggggttgctgagatggttgggcctgttgattttgagaacaatgcggagcactggcagcaggatcgatggagtgggcaatttcctgttaaatggcatgtcattaaggacgtgcctaacagtcagttccgccacctacttctggaacataatgacaacaaaccagttactcacagtcgagattctcaagaggtgagattgtcagagggactaggaatgttgaaaattttcaaaaactatgaagcggatacctctatattggatgatttcacctattacgatgagagggagaagtccttgctggaaaagaagagtaaacagcgaacacttcaacctggtagtgctgcagttactactgcagctgacacaataagtcaactagcggatagtctgccggcacattaaacttggaaggcaacaagaattgccctaaaaagagt

SEQ ID NO: 1344 - DNA, 317 bp, Nicotiana tabacum
attatgctgacatggaggtgaggaagtacgacaagcaaaataaagcatgggttaccataggaagattgcctgaaagagcaggttctatgaatggttggggtttggcatttagagcttgtggtgataggctaattgtaattggagggcctagagccatgggtgaagggattatcgaagttaattcgtgggttccaagtgaaggaccgcctcagtggaacttgcttgggcgaaagcgatctggtagttttgtgtataattgtgctgtcatgggttgctgagatacggagtttgccgtccatgcaggtagcagtgttttt

SEQ ID NO: 1345 - DNA, 474 bp, Nicotiana tabacum
ggaattattcccaaggcaatccttatcctagtgcaaactatggtactgggtctagttctctgtgggaaccaggtcacagaaattggctaactcctgacagaggtggaagacgtgagatgggatcggcactctgttaacatttctactgaatcacttggtatggcaagtgaacgaaaccgaggaccaagggcattaaaaccaaagagcaagggtcccattgaggatagctcttcatctgtcatccgtaaagaagttgagtcgactaatactttgcagcctgagcagtataatcggcctgaatttgtcactggttatgaacatgccaagttctttgtcatcaaatccttcagtgaagataatgttcacaaaagcatcaaatatagtgtgtgggctagcactcctctgggaaatggaaagcttgatgctgcttatcgtgaagcaaaagagaggaatgctgattgtcctgtttttctc

SEQ ID NO: 1346 - DNA, 535 bp, Nicotiana tabacum
cagggagggtatcccgccagacccagcagcgtttgatctttgctggtaaacaactggaggacggcaggactcttgcggactataacatccagaaggagtcgactctccatttggtcttgcgtttgaggggagggatgcagatctttgtgaagacattgactgggaagacaatcaccttggaagtggagagctcagataccattgacaatgtgaaggcaaagatacaggataaggaaggcattccaccagatcagcagaggcttatctttgctggtaagcagcttgaggatggtcgcacgcttgcagactacaatatccagcaagagtctactcttcatctcgtgctcaggctccgtggtggagacttctgaattcatgtgcgctaatgctgcttttatgatggctgtgtcaatgttgcttctttgttttgtttcagaactttaggtttcctccgttttccgttaaaagacatctcagattctgttatgttgttttcgctgctaataaagattgggcgctacttggctttataaaa

SEQ ID NO: 1347 - DNA, 475 bp, Nicotiana tabacum
ccaaaccttattgacttggacttgtcaagtaacctgctatcaggtgaaattccacctgagataggtaacctgaagctaacctcactcaacctttcttccaatcgcctaactggtagaataccggttgagttagagaatgcagcttttgatcggagcttcttaagtaaccctggtctttgtgcaagtgatccatcagtaggacttggcttttgcaaggggaaaacggggaagtccgataagctcccggtcaaacttcttgctgctctagcaagtgtaggtggagtaacagttctggtggctgctctatatagtttgttcgtgttgagaagctataggaaacgaaagcaagaattggttttgacatggaagctcacctcatttcacaagttagacttcacagaggcagatattgtaccaaatcttactgagaagaacacaatcgggagtggaggatcaggacaagtctacctcgtgc

SEQ ID NO: 1348 - DNA, 524 bp, Nicotiana tabacum
atgaaggaaatactggtataatagttgttgcggcaaccaatcgtgcagatattcttgactctgctttgctgagaccagggcgatttgatagacaagtaagtgtggatgttccagatatcaagggaagaacagagatcttaaaggttcacgcgggcaacaagaagttcgattctgatgtttctcttgaagttatagccatgaggacacccggttttagtggtgcagatcttgctaacctcttaaatgaagcagccattcttgctggtcggcgtggtaagacagcaatcgcatccaaagagattgatgattcaattgataggatagtggctggaatggaaggaacagtcatgactgatggcaagagcaagagtctggtggcataccacgaagttggacatgccatctgtggaactctcactccagggcatgatgctgttcaaaaggtcacattaatcccacgtggtcaggcaaaaggtttgacctggttcattcctgcagatgatccaaccttaatatccaagcag

SEQ ID NO: 1349 - DNA, 266 bp, Nicotiana tabacum
cagaattccccatccatcattagaagtcatcggcggagctcgagagaaatttctccctgcgtttacatcacttgataatctctacaattcttatcctatcgtcgcttcgaatcggcatatagagactatttttgcagctttttttaggtccgttcctgacgttcgtctccggcgagagtgtcttcggactaaggatgatggctccgtcgctctcgattgggtctccggcgacgatcgccgtttacctgccgattctccgctgctcc

SEQ ID NO: 1350 - DNA, 451 bp, Nicotiana tabacum
tagaagctctactttgagaagaaaagaagtgaaaaatggccagcataggaacgggatatgacctatcggtgacgacattctcgccggacggcagagtatttcagatcgaatacgccggcaaagcagtcgataacagcggcactgtcgtcggcatcaaatgcaaggatggaatcatcttgggagtggagaagctaatagcatccaagatgatgttgcctggatcaaatcggagaattcactccgttcatcgccattccggcatggctgttgcaggtttggctgcagatgggaggcaaattgttgcccgggctaagtctgaagcaaccaacttcgaaagtgcatatggtgagccaattccggtgaaagaacttgcggaacgcgttgctagttatgtgcatttatgcacactgtattggtggctcaggcctttcggatgtggggtgattcttgg

SEQ ID NO: 1351 - DNA, 501 bp, Nicotiana tabacum
ttttcacttcattcctatgtaattgctgtgtgtttgtgttaattcttcaaaccaaaagtaaaaaatcaattactagtagaaagtgaagatatgaggatggtaagggctattgattcttcagagtgtccaaatatttgtgggtttttagttgttgaagcttatcctaaaaggtattcatctaagatcccttctgatttagtccttttcttgggccttggctttattgattggtaatacattctccttttttctagtcccatatcaattttcttgatttttacataatcaaaaatacatatagttccgttattagatgcaaaaagatacagtttttctgtaggttttgggggaaataaagactatggggtttccaagatttcatttttatagcttttctttggagttttatagctgttgctgaatattttgactattttcctatttggggtttgtagttatgtgatgaaataagttaaagggatttagtggtggtgtgaatgt

SEQ ID NO: 1352 - DNA, 365 bp, Nicotiana tabacum
gtgtcttcatcacacgtgctctctcattcaatatcctttgctcctcacatttttgcttcttaattcaccctcgaagattccgattcagattccggtcaattctcgccggtaaatccctcagacaccggcgaatttcatcttccctcgatcgcaatgaatcccgagtatgactacctctttaagcttttgctcattggtgattctggcgttgggaaatcatgtcttcttctgaggtttgccgacgacacatatctggaaagttacataagcaccattggagttgattttaaaatccggacagtagagcaagatgggaagactataaaacttcagatttgggatacagatggtcaagaacataaaga

SEQ ID NO: 1353 - DNA, 331 bp, Nicotiana tabacum
aagaagcgacctctaccagccgcagcaggagaaggggatgtaccagcagcatcgccagcagccatggtgaagtattcgatgggaacccgacaaccctaccaagtcctgcaaagctaggggcgctagtctcagatgttcactttaagatacacacgatgatgacagcccatgcacttaggaaaatgcctttggacaaggccaagagatatctggaagatgttcttgcacacaaacaagccattcctttcacacgcttttgtggtggggttggtcgtactgctcaggtaaagcatcgccattcaaatggtcaagaacataaagaccatcaatc

SEQ ID NO: 1354 - DNA, 304 bp, Nicotiana tabacum
tttatgttcttgaccaattcttttagaattttattctcgctattgtatgcggctgcttttttgaggaagacatcgagttccttgagatcttcaagtagattctcagccgcatccttaatcccaataatcagttcctcgttgtcccgtagcaactgcatcaagttctctatcagaaaactcaaacctaaatccgccatgttttttccttcttatccaatactgtatttgacctaattcagttcagctttagcaattagcatagagagagaaagagactttgaggtttcggggaagatgtgcaaat

SEQ ID NO: 1355 - DNA, 276 bp, Nicotiana tabacum
accaagtatttgttgcagcaaatacgtgctgcttctaatgcttcagaggacagctgctcgtgttcaaaagagaccaagtgaacgcatagagggaactcatcaacaaaagccttcttcttccctaaatcgaagatcctgatctttgggtctggtacaccacggcagaaacgggatttcgggtatggcttgttcttacagtaacgataacatcttgctggtcgtcgacccatggtggcactttagaacaaccttccttcaagtgcttgctaacgtttc

SEQ ID NO: 1356 - DNA, 300 bp, Nicotiana tabacum
gttcttgaccagcggtgtcccaaatttgaagttttatggtttttccatcctgttccactgtgcggattttgaagtccacgccaatggtgctaatgtaactttcaagatatgaatcatcagcaaatctaagaaggagacatgatttgccaacaccatagtctccaataagcaaaagcttgaaaagataatcgtattctggattcatgactgctaaaacgtatgagatcggtcaaaatatggaagcggtgaattcaacaagtatttgggatttttccggcaggaaagagaagatgaaaatag

SEQ ID NO: 1357 - DNA, 295 bp, Nicotiana tabacum
accatctttcacagctgggtgacacgtgccaagtctccccttgtcgtgaaccaatgccagcaaaaaatttctcttcccatttgtctccccattttgttccaagctcagtttccgcccacttgtctgtccatttaagaacagaccctctcccgtcataatgctccccccatttctcccaccaagactgttcatttaatctgccatacttgtgggcccctttctctgtccaacccttagcatcatatttttcccaccaattctcataccacccagcattctctgtgcctgattttgc

SEQ ID NO: 1358 - DNA, 407 bp, Nicotiana tabacum
caaaggagggactcctttggttactcactctgatttctgaaattaaaaaacctaatttgcgattgatctcatccaaaagatgctattaagaagctcatcaagtcctttactgaattcatgggtaccaatctcgtgcgggtcgtcgccggaatcagacaagatgctaccaatacagacgccgcaattgattaggactggatctcattcgatgtctacgtcgtttggtcatgatgaatctccgaccaaacattcatccagccggtgcatgcgcgagtcggacctccgagatccagctgtacttcccaagaagaacaaaaacgggccaaagaagccgaagccggcgaagctaaaagagagagaagtgggtccgacagaggtgacgagattgttgtcgaattccggtttgg

SEQ ID NO: 1359 - DNA, 366 bp, Nicotiana tabacum
aatgcaacattcttcccacatgaacagtgactttgggagtggaatgcaacaatcctcttactctcatattcctaggggattgggaccaacagaacacgcttctccaaaatactatggacaggattccgatagggcccctggttactatgagcagcacaacaagaatactgatatgtggaatttgaagagtttggatgattaaattcccaacacttttatataaggtgaatctgtgtgctttggttgaggctttggctatatcacaaaggcctgtaacctaaataacaaatataaacaaccctgctgctatctagttatccatgtatttgcttttttataactaaactaagaataatttgaattaaa

SEQ ID NO: 1360 - DNA, 468 bp, Nicotiana tabacum
ggacttgcagtgacgagtctccagcaggcatagccttatattcaggggattggttccagttctccatgcaggatctgccagggcttcccatgaagagtctacagaagaagctctggactttgctcttcaacatgccaaaacaaaagggctatgcaagcaaggagactccgttgtagccctacaccgtgttggaactgcgtctgtgatcaagattgttacagtcaagtgatggatgacttttgacgcgtgcctttttgggtttctgttgttgcaaaagggtaactgataaatgtttttgcttgttgcactgaatcattttctgccttctagagaaggaatttatgactatacattatattttgtctttatataacgcctcgcccccttttttgctttccagcacaattttccaacctgacgggacagtgatatgatgtgaaataaattccctatggcttgaatttaaaa

SEQ ID NO: 1361 - DNA, 391 bp, Nicotiana tabacum
cttcagggcaatcaaaatttagcggaggtgcatttaatatcacatctgggagtgtgccttcagcaacaaattccagactgtcaccccttcctccagaaccagctgatttctatgaccgcaatgcatcaattgatattcctcttgatagttctgcggacttgaaaaagaaagaaaaagaattacaggcaaaggagagtgaattacggcggagggaacaggaactaaaaaaaagagaagatgctgcagcaagagctggcattgttatcgagaagaaaaattggcctccgttcttcccaattatccatcatgatattggaaatgaaataccaattcatctgcaaaagctacaatatgttgcatttacaacattcttgggacttattgcatgcct

SEQ ID NO: 1362 - DNA, 470 bp, Nicotiana tabacum
gtaaagtgttcctttcacagaggtgcactcgattcccatctttttcatgaactaattgcaccttttatttaattctgatcctcaaattggtcccattggaccatggatgtaataggaccaattgcaagaatggggtccaatgtatttgttctttccatttattttttttacgttaagggcgaattccagcacactggcggccgttactagtggatccgagctcggtaccaagcttgatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 1363 - DNA, 518 bp, Nicotiana tabacum
ctcttgcagccaccaaccgtaactttcgccaggcagctcgcattcttggattggactccaaacttgagaagagtcttttaatccctttcagagaaattaaggtggaatgcacaattcccaaggatgatggaacattagtgtcctatgttggattcagagtgcaacatgataatgctcggggtcctatgaaagggggaatcagataccatcctgaggttgaccttgacgaagtaaatgcccttgctcaactaatgacttggaagactgctgtagcagatattccatatggaggagctaagggtggaattggccgcaaaccaaaagatctaagcaagagtgagttggagcgccttacacgtgttttcacgcagaaaattcatgatcttattggaattaatacggatgtccctgcacctgatatgggcactaatgcccagactatggcctggattttggatgagtattcaaagtctcatggtcactcacctgcaattgtgactggaaaaaccgattgatct

SEQ ID NO: 1364 - DNA, 350 bp, Nicotiana tabacum
ttctgatcatgttttgcgcttcaacaatatcccacagatcaaaatgattgtggtacttggggaacttggtggacgagatgaatactccttagttgaagccctgaagcagggaaaaatcaacaagcctgttgttgcatgggttagtggaacttgtgctagactcttcaagtcggaagtacagtttggacatgcgggtgcgaagagcggtggtgaaatggagtctgcacaagcaaagaatcaagcactcaaagatgctggagccatggtccccacctcatatgaagcttttgaaggagcaatcaaagaagcatttgaacagctggtctcggatggcaaaacaactcctgtaa

SEQ ID NO: 1365 - DNA, 291 bp, Nicotiana tabacum
gcggtttaaggcctgatatgtctgaagatgagcgactcgctcttacccagaagtatgaagagttgcttgttgctggtggtggcatgtatgtggaggtgttcaaccgaggggttattcccctagcctacagcatcaggaggaaaaataaagctggagagaccaatacttacttggacgggatctacttgctatttacttactttaccaaacccgaatccatgacagctcttgaggcaacacttaatactgatgatgatgttatccgatcgtccagcttcaaaataaggaaaa

SEQ ID NO: 1366 - DNA, 436 bp, Nicotiana tabacum
agagcataggaaatggcaagcacagtaatgagcctcaaacctgcacctttcagtgtggagaagacagcagtgaaaggactgccatcacttgctaggtcttcttcttccttcagagttcaagccagtggtgtcaagaagcttaagactgacaagccttacggaattaatggaagcatgagcttgagagacggcgttgatgcctcaggcaggaagcaaaagggaaagggtgtttaccaattcgttgacaaatatggagcaaatgttgatggatacagccccatctacaacacagatgactggtctccaagtggtgatgtctatgttggaggtaccgctggcttagccatatgggcagtcaccttagttggcattctagctggaggtgctctccttgttttcaacacaagtgctttggcacagtagatcgttatccttg

SEQ ID NO: 1367 - DNA, 493 bp, Nicotiana tabacum
gaaaccttgtaataccagggatgattgctctagtggttggctgtgtagtgaatgttataattttagtaagacctgtgggccacttgttggtgatgctattatgggcatgtgatttcggtattacttctccttccgaccttccagagcaccggacaagtggcagactttatacatagtgaaacctcgtattaacaaagtaacatagtcctgtgtttgtaataaataaatagtcgctagcaatccagtgctcttcttgtaattgttgttgttgtgtgtcttttgtctttgaaattgtctatactcttgttttcaacttttagtcacttatatgataaataacaagtgacgaaagtgtcgttcaagaaaaaagtatgatgggctgatcaaaaactctgcaggttaaggggaaaaaaatctgccgctgttgatctgataaaatacagcatgtgtgtaatgtgttcatcaattaaataaaagaatcatagaatgtaaa

SEQ ID NO: 1368 - DNA, 413 bp, Nicotiana tabacum
gttcaggaaaagctgttgtgggttggctgaaaattaaggctgcaatgagatggggattctttgtgcggaagaaggcagctgagaggcgggcacagattgtggaactggatgatgaataaaatatagcgcttcgaggcttaaccaccgaccatttgaagaactattcactaggccgtggtgatgcaggtccgagtaattagctacacaggagtttatttccgagggattagtgaattcgttttcattctctttgcgtcaaatagtttttcatgtacagaagcctgtacagtaagttcacttttaatgctctcattgttaactcaatttgtgctctctttatctgtttcaagatgtaatgtattagtctgcagacccgaagggaaatatactttcaaagaactcgtgacccaaaa

SEQ ID NO: 1369 - DNA, 402 bp, Nicotiana tabacum
gaattcgcccttggccagaataaggaaagacccctagactacttaactaaattacagaaccaacaaagagacatcccgtctacctaatacaagaatcaaattcagcgacactcggacacacaatgaccattgacgggatctagagaagattgagatgtcacataaactcgaatctacccagcccgggtcattttcatttttggcattgccttcttcatctgccgagcacgctctttagcctctttcttgcgaagagcctctgcactaagcttagcctcagcttcctctatcttctttctctgctcagccttcttcctctgcagcgcttcctgcctggcattctgtagttctttgtaaatctcttgagcaatcttcgttcttgctccatcagtttttgtgcgg

SEQ ID NO: 1370 - DNA, 251 bp, Nicotiana tabacum
ttataacatacttctgagtgttaaatttttaatattacttctcttttagaattttaaaaaatatgtactttttgatttaaaacttatcttttaagtcatttaggtctatatttttacaaatttatttaaaagtttggacgttatagctcttttaattaaattaacttatttaacaactagatataaaaaaatcgtattcttataaaatctatgtttagttttattttaacttttttacgttaataaatact

SEQ ID NO: 1371 - DNA, 181 bp, Nicotiana tabacum
ctttcccctgtcttcttcccttccaaacacttctcaatattccctgaaaacaatctcacctttttttgcccacttcacttgtctttgtattatacacatacttcttcttttctctctgctacaatggcagtagcagagtttattccttcttcttcatttacaaaaaagaccaatgtttact

SEQ ID NO: 1372 - DNA, 214 bp, Nicotiana tabacum
gctgcttcctcaaatcgtcgaaaatgccgttcaagaggttcgtagagatcggaagagtcgcccttgtcaactacggggaggactatgggaagctcgttgttatcgtcgatgtcattgaccaaaatagggcgcttgttgatgctcctgacatggtgaggagccagattaattttaagaggctttcactcacagatatcaaaattgacatcaaaag

SEQ ID NO: 1373 - DNA, 391 bp, Nicotiana tabacum
ctcctttctctcaacgagttcaagccccatcttcttttttcaaatctcccagattcttctcttttcccattgctctgattctttgggaagttggttggaggggtaatttgagctcgagaattggatttggtcatcaatttcattgtataagaattttgtttgtcttttacctctgaatggatgccaagaagttcatgcaattggtcgaggagaaaaagaagagagctcttgagaagaatgaagcccgcttgaaatgggagcaaaaacttgaagctgcagcaagagcaatatctgatgctgaagctagagagaaagccaaggcagctaagcataaaaggaaatcggacttggagtctgatagtgccagtgacactgatagtggatatgaccg

SEQ ID NO: 1374 - DNA, 247 bp, Nicotiana tabacum
caataacaaaaaatgggttccatcgcaaaggatccacgagaggacgttattcaagcatggtacatggatgacagcgatgaggaccagaggcttcctcatcaccgtgagccaaaggaatttgtgtctcttgacaaacttgctgagcttggagtgctcagctggagacttgatgctgacaattatgagacagacgaggagttgaagaaaattcgggaggctcgcggctattcttacatggatttctgtt

SEQ ID NO: 1375 - DNA, 284 bp, Nicotiana tabacum
attttcctgcttacctggatttaaaggtgggaatgctgattatgctatggatcctcaccagaaagagcaactccatgataatactctttcgatgatgcagcaacaacacttctcaatgggaagatctgctggttttaacttggggggaacatactcatcgaatcgtccactgcagcagctgcaacatgctccatctgttagtagtagtggtgtctccttttcaaatataaataaccaggatctgctgagtttacatggttcagatgccttccaatcatcgcgct

SEQ ID NO: 1376 - DNA, 419 bp, Nicotiana tabacum
  modified_base (300)..(300): a, c, g or t
cttaaccccaaggcaaaccgagagaaaatgacccagatcatgtttgagaccttcaatgtgcctgccatgtatgttgcaatccaagccgttctttctctgtatgctagtggtcgtactactggtattgtgcttgattctggtgatggtgtgagccacactgtccccatctatgagggatatgcacttccccatgccatcttgcggttagatcttgccggtcgtgatcttactgattatctcatgaagattctcactgagagaggctatatgtttaccacatctgctgaacgggaaatcgtncgtgatgtgaaggagaagcttgcctatgtcgcattggatttggaacaggagcttgagacagcaaagagtagctccatcagttgagaaagagctatgagcttcctgattggacaagttat

SEQ ID NO: 1377 - DNA, 411 bp, Nicotiana tabacum
ttcaaacgtaacaaagtctatccatccagcttttcatgttggtactgttgcacgcactaaaatggcctctagtaatttgtcagtcagctgagcgtcttctactctctacaggggtcataggacattttccatttatgcggttgacagcaggtgcaataacacgatatttttgtttgaacttcttcctccatcccttctcacgtaccacatccatttgtgacttttcaaccctcgtgccgaattcctgcagcccgggggatccactagttctagagcggccgccaccgcggtggagctccagcttttgttccctttagtgagggttaattaagggcgaattccagcacactggcggccgttactagtggatccgagctcggtaccaagcttgatgcatagcttgagtattct

SEQ ID NO: 1378 - DNA, 71 bp, Nicotiana tabacum
aagtatagttgtctggattggagggtcaatttctagcttctctcagtaccttccaacaaatgtggatttcc

SEQ ID NO: 1379 - DNA, 154 bp, Nicotiana tabacum
gtttgccccggctttttatttcaccattatgttgtttcagtcgacgagagatattggtggtgacaccaacataggtcttgataggtgaatttgtggagagaataaggtatacacaccataaagacttgatttttttgaattttcttgaattatt

SEQ ID NO: 1380 - DNA, 313 bp, Nicotiana tabacum
ccctttcgcaagttttagatccttcattgttgtaagttgtaatcggcggcgagtaattttgttgaagggaatggagggaggtgcagcagcagagaaacagaacgaagctacagcgtcttatacttattgggtgagggaggcgacccccacgatgctgcacctttggcctcttcctaggaagctcacttctcaggacctcaacaatcaagccaattatccccaaacccaccttgggtctgcctggaatcgggctggaacatgggaggagaaaagtctaaataaatgggctaatgataagaattaaggagctgct

SEQ ID NO: 1381 - DNA, 390 bp, Nicotiana tabacum
gaattcggcacgaggctcagctacgctgcttgctgcactctgtctctctctctctccctctctcttggaaaatttgcaacaaagaaaaatgacgacggtggtccctacttcagaggaagatcccgtgctctccgtcgtccggtttacggcggagatgtcatggtctgacgccggcgccgatattgcagagcctcaagttaatagattgtgtgtcgaggcccaggaatgcattattgaaggaaggtggttggatttggcttcgttgatgctcacttccgcagatttaatattttctaaagcttctgaaaaagatcttgagtgcattttcactatcatttgcaaccttgtcaagaagcctgagagcttggaccaagtacatgagatggcaga

SEQ ID NO: 1382 - DNA, 498 bp, Nicotiana tabacum
atgtccccgcgaacttagggttcccggaggatgtaataacccttgtactacattcggaggacaacaatattgttgcacacaaggaccttgtggtcctacatttttctcaaaatttttcaaacaaagatgccctgatgcctatagctacccacaagatgatcctactagcacttttacttgccctggtggtagtacaaattatagggttatcttttgtcctaatggtcaagctcacccaaattttcccttggaaatgcctggaagtgatgaagtggctaagtagagtggctatttctgtaataagatcaccttttggtcaaattattctatcgacacgttagtgtaagacaatctatttgactcgtttttatagttacgtactttgtttgaagtgatcaagtcatgatctttgctgtaataaacctaagacctgaataagagtcacatatgtatttttgtcttgatgttatatagatcaataatgcatttggattaaaa

SEQ ID NO: 1383 - DNA, 228 bp, Nicotiana tabacum
gttaagccaagtcaacaacctcaaccgttcataatctacttaccccatttcattttttcctccaaatttcacctgaaaaaaaaaaatggtggagctaaagaacctccgatcaaacacattaacacttgtacttgtaaatcttgctagtataatggagaaagctgatgaatctttattacctggagtttacaacgaagttggcaaagatttacatactgacccaactgg

SEQ ID NO: 1384 - DNA, 272 bp, Nicotiana tabacum
ctctgctgcgctgcttgctgcactctctctctcttggaaaatttgcaacaaagaaaaatgacgacggtggtccctacttcagaggaagatcccgtgctctccgtcgtccggtttacggcggagatgtcatggtctgacgccggcgccgatattgcagagcctcaagttaatagattgtgtgtcgaggcccaggaatgcattattgaaggaaggtggttggatttggcttcgttgatgctcacttccgcagatttaatattttctaaagcttc

SEQ ID NO: 1385 - DNA, 386 bp, Nicotiana tabacum
gttgtgtgaacaatgcataagaaagtgggacatcagcagtgttgtaaatgtgaccaaaataaggatagacattggctaagagtggaaggttatttcgtgctagaaattggattatgggattaatgaaactattgaattctcctcgaaaaatactatctttaggtgggtaggtgtttgctaagagccctgaatatgttgcagttgaaaccttgatttgatcttgcaaccctgctgctgctaatgcattgtacacattttgcatggcaggaccaacaaatggtgcatattgaccattatttgtaggagatacttcatttccaacagctatatatttaaatttaacatctggaaaatgatttattatgttatcttggacccatccattg

SEQ ID NO: 1386 - DNA, 240 bp, Nicotiana tabacum
gatggctcgagacagccatccgatcttgaattgcagcaggcgtttcaccagggtaaatacattgccggtattgccaagaaactcaaaggtgcagcctaatttctctcctgcaaagataatctttgcattcacacatttcttctcaaatcctaaaaaaaagaactacaaaatttatatctgtgattgtcgaagtctattttcctttattgggtatgaaatccgatctgtatgtgtctgatt

SEQ ID NO: 1387 - DNA, 412 bp, Nicotiana tabacum
tactgcaaaggccaagcccaagatcaagaggggtacaaggaactgtagaattttgataatgaattctggagtcttgtctggattgtatggggcttgttgcggtggaacataagaacgttttagtggaactgttgacacatcgatatccccaatgtaatacttatccatcatctctctagcagaatcactgtggccaacatcttcaaagtcattggttgcatctttcccagttgctgaaagcaaaacttcatcaccaccaggatgatcatccataaatggagttacatcatacacctttccgctgataataagccagcaatctttggtcttgttgtgtttggcaacctcctcaaatccatgaactttcccatctgacgccatcttttcctgctacgagagacagagtttcttc

SEQ ID NO: 1388 - DNA, 235 bp, Nicotiana tabacum
tggttaagttgaataaagacaattagtggagcggctactctggagggtgaaacaaattgaaaagatgcatagtcatctaaccttttctgaatgtcatgcaccaaatagtcagttttctttgtgattgtattgatatattcactctaggagatctttttatcaatgtcataatgccataatcttttcatttggtgtaacagtttcaggttataatgacagcatggttgctagaatg

SEQ ID NO: 1389 - DNA, 264 bp, Nicotiana tabacum
ttcttcccctctgctgcctattagcgctagtagagtaggattgacccgtaatacagaacctctaggcgtaacctttcgcttaatactagaatcgagaatcgaaacatagcatctgaggttgcattaatcgaggatacacgacagaaggaattgttctatttccaaacttcaccttcaaaaagcgtagattttttcaaaaattttctcggatcacgtgtttttctcctcgtaagactgagagaaatgactaaatatgagataaaa

SEQ ID NO: 1390 - DNA, 273 bp, Nicotiana tabacum
ctttttcccatgagaggtaatgagaagaattctagaatggattgctacctatgcctagatcacggataaatggaaattttattgataagaccttttcaattgtagccaatatcttattacgagtaattccgacaacttcaggagaaaaagaggcatttacctattacagagatggtgcgatttgattctttttttttatatttagtcatttctctcagtcttacgaggagaaaaacacgtgattcgagaaaatttttgaaaaaatctacgctt

SEQ ID NO: 1391 - DNA, 266 bp, Nicotiana tabacum
aaaaaaaccaaaaatccatatacagaatagagatattttttcaaataagaaaaaagatgagcggaatagcacaagattgggaacccgtcgtaattcggaagaaagcgcctaccgccgccgctcgcaaggacgagaaagccgtcaacgccgcccgtcgctccggcgcggagatcgaaactgtcaaaaaatctaatgcgggctcaaacaaggctgcctcaagtagtacatctttgaacaccaggaagcttgatgaagacactgagaat

SEQ ID NO: 1392 - DNA, 237 bp, Nicotiana tabacum
atcaatccaagtgcatggaggtggtttttcaatgtggtaggtgatgcaaggtgccccatatctgacacatggtggcaaacagaaaccggtggcttcatgattactcctttaccaggagcatggccgcagaaacctggttctgctacttttcctttctttggagtccagccagtaatagtggacgagaaaggtgttgagattgaaggtgagtgcagcgggtacctgtgtgtgaaaagt

SEQ ID NO: 1393 - DNA, 333 bp, Nicotiana tabacum
catcacgatcccacagaaaaacacagtgaggattgcacttaaatagaataattcagcaagcaggtatgacagataagccatgagtatcattatagcaacctcacgatcagtggagtgccttccaaagtagagttttttaattatataggcgctcagtagaccagcaacaacccctaagatggtgcttgaagcaaacaagtacagaaagtttccaactaattgcagagctttgcttgtgttgatatgagataagtcaaagttctggacagcattgaacagaaccacagatgtggcatcattcacaacaccttcccccaaacactagactgtaca

SEQ ID NO: 1394 - DNA, 384 bp, Nicotiana tabacum
ccagagtttcaaaatctaattttcactgcagtgatatcaacattacaaggaacatatcatgccctgtctcgccgattggtagccctcttttacatccaaggtcacctcaacacctaaatgggaggatgtctccttcacccatatcaagtcctatcaccatgtctggctcatcaacacctctctctggagggactggtgctatcccatttcatcaccttaatcagtcagtttacttacaggaggcagcaccacttccacagagtccttatatgaatgggccttcgtactgggatcctgatgttttacgagggacaccgtcaggatctcatgctttccgggaattggcatcctctcaaaatgatgctcttggaaagcagttcggga

SEQ ID NO: 1395 - DNA, 392 bp, Nicotiana tabacum
ctcaagtaaaacttggaaactctctttcctagtttccgctgaccactttagcttttcccatcatcaaaatgaatagccttagacgatctcaggtgtttaaattcgaaagtttggagaaatttctctcagagttcctctcttcagcagagtgctgtcgcagaacctttttcagtacccaaagcaactgaagatgaagccgtctctccaaaaatagaaaaaataattgcagaaatcactcaattaactttaatcgaagtatccgaattgagcggagccttgaaaaaacgcctcaacttgcctgacgcacctatgatggcaatgggtgccatgaatatggcagctgctaaggaagagccagaagaagtcgtggtacaagagaagcaaacgatttt

SEQ ID NO: 1396 - DNA, 548 bp, Nicotiana tabacum
gccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgtggggaaccggagctgaatgaagccataccaaacgacgagcgtgacaccacgatgcctgtagcatggcaacaacgttgcgcaaactattaactggcgaactacttactctagctt

SEQ ID NO: 1397 - DNA, 460 bp, Nicotiana tabacum
gcggcattttgccttcctgtttttgctcacccagaaacgctggtgaaagtaaaagatgctgaagatcagttgggtgcacgagtgggttacatcgaactggattctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggacccggagctg

SEQ ID NO: 1398 - DNA, 401 bp, Nicotiana tabacum
aaaaaagagcttgaacttataattttatttttaatgttcctttggttgaaagttgttttgagctttgttgtagatattgttataccaaaataagtttggaagttcctgaaaaggcttttgtctaggggtgttcataaaaatccgaaaacctgaaccaaaccgaaaaccaaaccaaaccgaccaaaaaagcggatactttttgtttggtttggttttggttttgaaatttaaaaaccgatcaaatttggtttggttttggttttagttaaaaaaaccgaaccaaaccgaatataggagtagctattttaaatttattattacacctatatatatatgtatacttttgtacaaagttttaaattttttatagtaaataataatcgtttgcacttttagtaaaa

SEQ ID NO: 1399 - DNA, 433 bp, Nicotiana tabacum
aagtgttttgctcggagcataggtattccgatcggcatgactgtagttatgattacaaggcagctggtcgtgatgcgattgctagggaaaatccagtagtgaaagctgctaaaattctcaaagtttaaaaattggaaaatttgaagatttttcccgaaacatcttgaagcagtcaagatgggggtggtggttttgggtgttgaatgttgggggtgttgttgtaaatttaacaaaaggatgagggtattgttgtcattaagttattaaaataagttagtggagaacttttcttttttctttctttccttttttaagttttatatctgtttgttttaattttgtgttgtgttgtacatcctgcattgtgtcaggaaaattatttatccttacatactaaagttattattaacactcagtacttaaccaagtaaaa

SEQ ID NO: 1400 - DNA, 357 bp, Nicotiana tabacum
ttcggcacgaggacacaaattgccatcaatttcatcgcttgtgcaatcgtgttcaattccagagtgattcaggctgttgaatgaaaggagaacaagatctcgcagtggcagttagtttcccattgaagacggagaaccttatcagaaaaatttatgctatgcgcttcttggaggagtgagatgcatatgaataagtttatttttcttatattaagtgtgactataactctgcgtaagttagtatatttaatttcgattatttattcatgtcatgggattttttatgattggtatatgctgagacgatatagaccatataagtactgtatttttggaattgctagcacttgtactaaa

SEQ ID NO: 1401 - DNA, 203 bp, Nicotiana tabacum
ttattgtttgtcccaccaaactgtgggttattttcctttctgtttgctcagttacacaaccaagaaattcatttgctgcattgtctgattgaggccaaagaggcaattgtaaccaaccattataaagtgacgttcatgtttctgatacgctggttaaacttaccaaagtgccaggtacgacgtaatttttcccttggataaaa

SEQ ID NO: 1402 - DNA, 361 bp, Nicotiana tabacum
ctcgttaaagttcatcaactactttttgctcctaaagatataattccggtggaaggcctcaagcttgatgatgctgtcccaggagtttacacaattcactgcctacctctgaggctgaatcatggagatggttcacctgccaggtgcatcctcttccggtaatcatgtcaaggcagttaatacttttcacgggaaaacagaaaattgtcaaaatttcaaccagtttcgttaactaagaatgtccaagaaattgttatgagacttagatgtattatatgtactagcttcctttagctatatcatttacaaatagtattctgtataagctttgcatgagttcattttaaacatcataataaaa

SEQ ID NO: 1403 - DNA, 308 bp, Nicotiana tabacum
tttgaacaaagaaaacctgtcacatatgagcttatttatcgaaccaagaggctttcataagttttggtacaactgaagtagtgaaacataggagtatcaccagaactgacatcaaactaaaggcagcaggctactgtctacacaactaagcagattgtcactagaacctaagaaccatcatcgtcttcgaggttgttgactctttcacactcgtcaatccattcactatatatatcaataggctctgtcagtgccgtaacagtggtgctgaagctctcttgaacaaatcctgcatgttgcctccccaa

SEQ ID NO: 1404 - DNA, 458 bp, Nicotiana tabacum
agacattagcgatgatattgacttctgtttcaaactggcgaaagaaaaatctgttatactccttccaggactcgctgtgggtctcaaaaactggattagaataacctttgcagcggatccgtcttctcttgaggaagcactaggacggctcaaatcgttctgtcaaaggcattcatatcaagaaaatggtcattgttgattctacttagtaagcgatccttgtaatcgatcttcttctctgctgagcacctatagctacagttggattgcttagtcacagtcatagtgcaagttataacaatttattgatttatgaatatacttgtctatattaattttataggttgattacatggcaagttacaaacacattcaactgccaatcatgtacgtaataatgtgcaagaaaaacctgaattacacataccaaaaatgaaatatgtaattactattgaaaa

SEQ ID NO: 1405 - DNA, 277 bp, Nicotiana tabacum
aaagagctgtgtgggttaggagaaggtatttgcattctctaattaaccgataatcagatccaaactcttaaccctagaaaatcaaccatgtcttctaagcaaggtggaaaggcaaagcctttgaaggcaccaaagagtgaaaagaaggaatacgacgagaatgacaaggctttccttgcaaagaagaaggaagaggaaaaggcactaaaggagctcaaggcaaaggctgcgaaaggctccattggtggtgctggcctgaaaaagagcggaaagaaat

SEQ ID NO: 1406 - DNA, 286 bp, Nicotiana tabacum
aggtttgaagaaccgtgtcgaatctctgaaggagctctgaactcggtgtctcgatcccttcaacttgattcatagttgcatgatcaaaggtgaagcaaatgaacaagggtagatgaatgcggtgaagaccttactgaagagtattggttgattgcttatagactttaagatgttctagaatcttgtgttttaaattattttgcaatcttatgtattaactcttgaattgtctaacaatattatgtactttgcttttatatatgaataataataatagttgaataaa

SEQ ID NO: 1407 - DNA, 286 bp, Nicotiana tabacum
agaagaaagggatgaaggagaagattaaggagaaattgccaggaggtcacaaagacgatcagacccattcaactgcaacaactacgactacgggttatggtatggaaggggagcatcatcatgagaagaagggaattatggacaagattaaggagaagcttcctggccaccatggccctggccaccactagaaaatctgctgcgaaacaataaatacctttaaagatacatgtaaaatgttggtctaatacttttgtatttcaaggttgtttctagttggtcttgg

SEQ ID NO: 1408 - DNA, 341 bp, Nicotiana tabacum
cttccatttttgtctctctctctctctctctctacaaacctaatactacatcggagatacagatctaaaacatctccaaaaatctaaaaaaatggcattgggtggaggtggtccacagagaggtactgctgcagcctctgctgccaacctacggcgcaggaggacaactagtggtggagctgctggaggagccggtggtactatgcttcagttctacactgacgattccccaggactcaagatttctcctaatgttgtgcttgtgatgagcattggtttcatagcttttgttgcactcctccatgtcatgggtaagctgtacttgtccgcaaggaagggta

SEQ ID NO: 1409 - DNA, 221 bp, Nicotiana tabacum
ataagggctcgttccgcaaattttccttcccctaattttccccgttaattggtataggtaggaattgagtttcgggtaggttttattttgtagcatatgggtttcttatcccctaggaagaggttatccaatcattttgcaagtctctttgtagttgaattaatttttggggctttttacttgtgttaactctttaaaatgaattcagtttaggcgtaaaa

SEQ ID NO: 1410 - DNA, 350 bp, Nicotiana tabacum
ccaggaattcggcacgaggaaggcgtacggagagttgccagagaacactaggctcaatgaggttaacggattggatgaagaagatgatggtgatggtgatgactacattgagtttgaagacgaggacattgacaaaatctaaatttcctgatttaaatagtgctgtcactggggttcctgctgggcgctcaaatatttctgtggagtttgaatttaatacaaaaaagagagaactcttatatgtaccgtttgaagtaatatgattaagctttatgcattagtatttctgtatgaagatttattcatgctttgatgaaacagatgcaataacagctacctgttctctaaaa

SEQ ID NO: 1411 - DNA, 322 bp, Nicotiana tabacum
ggcggattaacgaggaacgtacatccattctaacaaggcataaaaattggtgcaatggagttagtcttaagttattttagtttttttttcttgggttgatgaaatctttaattttttttaatattatagtgtagttggttttggaagatatgttgtcaatattattaggtcggtttgattagatcaatatggcttaagccttaagggatataggtataagttggcatttcccccccttatttgagctttgtaaatcttaatttaccattttggttttactacttttgcaaacctttgaccatctattggtggttgtataaaa

SEQ ID NO: 1412 - DNA, 460 bp, Nicotiana tabacum
ttttgacatgctttttaacattcgaaatactataaaggaagatgcattagttgacatgctgatttccacaccaacatagtctaatacaaatatgcataaaccgaaacagataaggaaatgttttatgctgctgagtactgatggcatatgccatatattggcatgctctattgtctgcgtctaactagtattagcaactaataagtaagtccacaaacgaacaaacaggtctgaaatatcccctttcaaacttcagctgccataggaacgatggtcgagcagacgccaccgtttattccttcttacctatgccatgagacatattgtagatccctctcccaatcataaacaaagcagtagctgccaaagcagctggaatggccactgaggtgatcttgtcataacgacctttcaggtatgtgtgcttgtgaacactttggaaaaacttttgcttctcaac

SEQ ID NO: 1413 - DNA, 415 bp, Nicotiana tabacum
ttttgactaaactaagtaagggtatcaaatttcatatagtaaaatactgttgcaacagaagctaaagctaggctgagaaacctactaacaacgcaacaacgtttagtacgtggaaaacgaatatagatcatacagtttcataaaccacatcataagaaactaagttggtgcataatgaagcacccttcctaacaatcgcgattgcgtttctacttactttctttaggtcaacatgaggtcatttcccccaaggtgaggacggaggcaaacgcgaacttcatgttcttcaggcccttcacagagttttggcaccaacatctcgagcactgttcctgattcgtcgtaatatgcttcaattttagcatcttcaggaattcttgttgagagaggaatttctctgacaaactcccctgga

SEQ ID NO: 1414 - DNA, 285 bp, Nicotiana tabacum
gatctttgcatctacaatggtgaccactggaaagaaaacaaagaagacacatgaaagcataaacaacaggttagcacttgtaatgaagagcggcaagtattctcttggttacaagactgttctcaagaccctcaggagctctaaaggaaagttgatattgatatccaacaattgtcctccgttgaggaaatctgagattgagtactatgctatgctctctaaagttggtgttcaccatttcaatggaaacaatgttgatcttgggacagcatgtggcaagtattt

SEQ ID NO: 1415 - DNA, 420 bp, Nicotiana tabacum
acttaaaaccaaaagtacaacaccgaaattgcatacctttctaccaccataattgcatacaatcaaagatcacgacaactagtttaagaaattaaactagctagcacgtccatctttgaacaatcatagtgcttatttcaaattaagtgacttttacatacataattaagggataatattctcaattagcaaggcctggtacagaaacaacggcggcggaatccacggcagtcgccaccggaaaatccttcggtcagacaaacggtggcacagttgctatctcttgagcatggtcccttgaaacggtggctctgggactcacaagttcttgcctctgcaattgtcattggtcccatctcggtagccgtgacaagcaatgctataagtaacacagttgcaaagaagcgcatggagttgcca

SEQ ID NO: 1416 - DNA, 349 bp, Nicotiana tabacum
ttttgcaacgcaaattagatttaatcggatttgatatcaagtggctaaagaaaaatacagtacaataccatacagttgaaagactacaagacaagtggtactaatagaattatattaggctattcataactttccctttactctcaaaactaactcacaccagcacaagtacatagtctcaaggcctaactttagtcatgacatttaggacatttgctgcaaatctggtatttacatgagcaaattttacaagctttgccggcgactttgcctcctggttttgcaccttttcgtatccaacccggtatcttacggatgattccggcacccgtcttctgattagtaatgt

SEQ ID NO: 1417 - DNA, 209 bp, Nicotiana tabacum
gaaatagagaaagcagtggtagcgtatttgaagaagaagggtttcaagcaaactgagcttgcttttcaagaagaacagcaacttaataaaaacacaaattcccaggttgaccctgacgttaccaaaaaaatcctctctttctctgaatttgaaactggtcctgaacggtaccaagaagaatatagcaagcttcgatcatgggcttatag

SEQ ID NO: 1418 - DNA, 590 bp, Nicotiana tabacum
taatgaattacaccacttattcatcatacaaaagcgcgggtagataagaaaaacagtaataatacattctaaaatccctttaattattcaagaccagaaccacccaataggctctccttcttcatgttgctgctcctctgccgccacaaagacgttacagaagtagccatggccgccgccgtcatcactaccatcatcttcctccgactgcaaaccatccataggcggaggaatattattacatcctccagcccctagtggatactcttccatatgaccagtgtgaaaataggagtccccactgtccaccagctgtggactgtgcccatctaccaccgcacttccgccgctgccactgctcagcctgtcctccgccttcaccttcacttgaagggtcagcgcatctacctccaaaacctcacatttttcatttattacccctgcttcaccaaccactttcccctgcaacttctccatcaatgaaaccacctcagctttgagcttctcattatctttgcgaatggagtcaaaatcagagagaagagagtcataagaggatttgagctgatcataatccctttcgagcgtct

SEQ ID NO: 1419 - DNA, 375 bp, Nicotiana tabacum
gaaataccgtaaataatacattctaaaatccctttaattatttaagaccagaaccatccaataggctctccatcttcatgctgttgctcctctgccgccacaaagacattagagaagtagccatggccgccgccatcatcactaccatcatcctcctctgatggcaaaccatccataggtggaggaatattattgcatcctccagcccctattggatactcttcaatatgaccagtgtgaaaataggagtccccactgtccaccagctgtggactgtgctcatctaccaccgcgcttccgccgctgccactgctcagcctgtcctccgccttcaccttcacttgaagggtcatagcatcaacctccaaaacctca

SEQ ID NO: 1420 - DNA, 265 bp, Nicotiana tabacum
catcatacaagcgcagataattaagaaataccgtaaataatacattctaaaatccctttaattatttaagaccagaaccatccaataggctctccatcttcatgctgttgctcctctgccgccacaaagacattagagaagtagccatggccgccgccatcatcactaccatcatcctcctctgatggcaaaccatccataggtggaggaatattattgcatcctccagcccctattggatactcttcaatatgaccagtgtgaa

SEQ ID NO: 1421 - DNA, 418 bp, Nicotiana tabacum
acaatgcaatggcatattgcatggtgtgctccttatttatacataacgaaaaacgcctcggttattggtatgcggtaaaaccgcactcaggcggccttgatagtcatatcatcctgaatcaaatattcctgatgtatcgatatcggtaattcttattccttcgctaccatccattggaggccatccttccctgaccatttccatcattccagtcgaactcacacacaacaccatatgcatttaagtcgcttgaaattgctataagcagagcatgttgcgccagcatgattaatacagcatttaatacagagccgtgtttattgagtcggtattcagagtctgaccagaaattattaatctggtgaagtttttcctctgtcattacgtcatggtcgatttcaatttctattgatgcttt

SEQ ID NO: 1422 - DNA, 271 bp, Nicotiana tabacum
tgcgatatcaccgctatcccacaaggcgtaaccaagcgctgcctgggtgttgctattattcggttccagttccagcgcggcgcgcaaatcactcaccgcggccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgcttcccagtccacgt

SEQ ID NO: 1423 - DNA, 326 bp, Nicotiana tabacum
agatatggactggtgtcacgtatggtttggctgccaccatgcttcatgctggtatggaggagcaggcgttcactacagctgaaggcatattcattgcaggctggtcagaggatggctttggatactcatttcaaacgcctgaaggttggaccatggatggacattttcgatctctgatatatatgaggcctctctcaatttggggcatgcagtgggcgttatcaatgcctaagacaatcccttgatgcccctaagatcaatataatggacagaattcaagtgtccccctatactcctcaggagatgggcgtccgcaaaatagtcga

SEQ ID NO: 1424 - DNA, 441 bp, Nicotiana tabacum
ttttgaaaagcaaaaccaaaaaaattaaattggatgaaaggaatatgacagtgttacctctatggactactacaatatctcagcaaccggataactttgtcaatgaaattaccaggaagaaataagtataggataagattatatcaaaaatattactactaaaaagaaatcatttctcatgtgttggaatatgctgattccctcttctacaattcctggctcaccaaagtgctcaatatcaacagtgtcaaaataaaaaggtggacagggcgagtaaatatatggtttgtgcttactccaacaaacttggaatgatccacatcttcatcatgcaccaagaataggagaactattgctagtataaaccttaagatagagatggaaataatcccttcactcacactgagacgacctgctcaggtgcaggcggaaatgtatggt

SEQ ID NO: 1425 - DNA, 251 bp, Nicotiana tabacum
tttgggacaaagtctttgtttattataaacgattatagtcgtgatcccttcaggtcacaatcacacattcacacattcacacagtaactttattcatagccctaggccctgcattgcaagggaatacaacaaaacagatcatgaaattacatagtatcgactaaaagtccatttccaaaagacctctggttgccgcaatccagattgtcaccaggactaactccaagaatactgcaatacctcctgtaaaa

SEQ ID NO: 1426 - DNA, 205 bp, Nicotiana tabacum
atgaggccagtaggtccggaaatgatgttcctaagtgagtatgcattaccccggtaagcacttggttccctgcagtatagtattttacttggtcctacaaaagttgatgcgacaaatgagtttccttgtgaatgttttattttttcgtggagaacgatggttgagataccaatttttaggttgttttgggattggggtggtgttg

SEQ ID NO: 1427 - DNA, 223 bp, Nicotiana tabacum
ttttaaacggtaaatcttcattcacttcattccagatgaactttgtaaatacagatccacaacgtaacatcacggtaacaatctcacggtcaaaaacgatggacagtagcaggaaccacagtaaaccataacggaacttcaaccaaacttagaaccataaatttcaaaccaaaaaaataaatctaaaggcaacggaaaatctaactcctccagtttccttcag

SEQ ID NO: 1428 - DNA, 223 bp, Nicotiana tabacum
gaagtgtaaagaaggaggggtacttgaattcatggatgtagctcaagagcttgtccaaattccttctactagtgttagggttctgtcttctagtagtaacagtgtcggagccatcttagtctaaggggtgtcggtcttcgtcaaaaaattatactatactatgcatagttaggtcaattttatattatttcacgtgtgtatatatatattatattttgaatcc

SEQ ID NO: 1429 - DNA, 305 bp, Nicotiana tabacum
atctaatgttaatgacattttctatgaaatagcaaatagactgcctcggcttcagccagcacaaaatccatctgggatggttcttatggataggcctgctcaaacaccggctagtgcttcttgttgctcttaaatgtctattagtgcttctcattacaatgctgttttttgtttaatgtgtttgtgctgattgttaagagtttgttgtgccatttctccatcattgtacagatatttcatgaaaaattcttcaagatgatttgactcttttctttgaatcctccctatgtaatgggattctaaaa

SEQ ID NO: 1430 - DNA, 368 bp, Nicotiana tabacum
tttttaataaaatttgggcttttatggaattgaaaaaagtgaagaaagagaaaagaaaatcggatgaaatcccaaaactacactcaagatatgttccagaataaagaagtaaagagaaataaaaaggatgatgaagaagtctaatttaaagaaagaaaaacaactaaagagaaaaaaatgaataaacaaatattagaaaattttaaactaggatactagttaccacgtgtttacttctagtttgatttgtgtacgttgtgcactagcgagtcttctctagattgttgtaggtgcagtgtcccattggaagttttccgatcaacgaacatcgcagttgattttcatttccgaagacgaacttgttgcct

SEQ ID NO: 1431 - DNA, 329 bp, Nicotiana tabacum
cttgctggtccacaatccatcattggaagagctgtggttgttcacgctgatcctgatgatcttggaaagggaggacacgagctcagtaaagctactggaaatgctggtggaagggttgcttgtggtatcatcggcctccggggttaattactcatgtgccgtgaagattctcagctactagtggagggtatcttggaataaggtttcgttggagctgctgagctttgttctctgtgtttttatcatgtgataccttttgtttttgagttgaaccaaccatacatgatgtagctctgcttttcagtgtgtcagttgtactagtttttgcc

SEQ ID NO: 1432 - DNA, 274 bp, Nicotiana tabacum
ttttaaaaacatgactctaattcatttagtagctagaagaaattacaatcacatacaatcaatgacaaagtagcaaaacaaaatactcacaagatactacctactatgtgaaaagctggctatgctagttttctttaataggtagttttattgccacaaccaaatcatgataattcacaaataagaagtgtttttatttgggagctgcagtttgaaagcgaggttgaaaatgggcaagtaaagcatcccttgaaggtaaatattccttaacttg

SEQ ID NO: 1433 - DNA, 391 bp, Nicotiana tabacum
ttttacaaaagtaagtgcttgcatgctcaaatttattactatatgaaattgcaaatttgtaagaaatttcataagccaactgtctgcagcaagagcaaaaaatcataaacaaagaaccttttcctacaataaagattaacaattccaatatatatgcaatcagaagaaactcgagcttttttcatcaaaattattgttgtctgcagttatctccccctcttcagggtccaacttccaagcaaggcaatcagaaaatgcaaccatatcctttgccttatggaagtgtagttctgacttctttcctatctgctccaaaggcctcaactccaaatcctttcacatatacattggtaaacagttctgaaggatcaggcatgggactctcctttgc

SEQ ID NO: 1434 - DNA, 367 bp, Nicotiana tabacum
cctcatccgagctctttcctctcagaaacttaccaagttcagcatcaaatggctggccataggattgcacatgccacattgaaaggccctagtgtggtgaaggaaatagttattgcaactgtacttggtttggctgctggtagcttatggaagatgcaccactggaatgagcaacgaaaagttaggtcattttatggcttgctggagaaaggtgaaataagtttagtcgcagaagaataatttttcgaggatctcgcgtgagttggctcttcaattaaacatgggcacactcttatgtctaaaagaataagtttataaaccaagtatctctttgtctattcattgctccatgtttgactattaagtt

SEQ ID NO: 1435 - DNA, 443 bp, Nicotiana tabacum
ttttatggaaacatattatcacaatatattgtacaacaaaacattacatgaccaaccatccctaagaaccgaatggctttattcatacttgttacaagcaaggtctaaagtagcacaatgtataagttatatacgctaacggcatatataacttacactctttatatattacacataatgatcagttgtgaggctgagcttcagtgactttatccatggcctcacctgcgtaggaacaacaccttttgcatcctttgtaacctttcctgcagcaaccatagcggcatcctctacgtttataaccaccaccataatatccatcacccgccaacgtcattgtatccactacgtccgtcaatagatactccattctcgttatccaattttcattgagttgggaagtctcagcccaactcagcagctacaacctcagagccttatta

SEQ ID NO: 1436 - DNA, 473 bp, Nicotiana tabacum
ttttcttggaaatttttaacgaactgcttaagcttcgagtcaggaaccaaccaaggacagtgaaggccataagatggtacagatttgcaaaaggttccaatagaagaacaatacagagaggacaatactcatctacattcagctaatacaataagcgaagaaagaaaaatagaagggcaacctgcagatgcgcaaagaacaagaatgacataactcagttgctaatcaagcatccaaccatagtatccaaggcacaacgccacgctcagcagacaaaagttgaaatcctactgccgcatatcactggtgtctctggctactaacaactactaatactttacccaaaaagtataaactggtaagctgatggcaagaaaatgcccactagacaaacgaggtccccataattgcttatgcccatgcctcgtgccgaattcctgcagcccgggggatccactagttctagagcggcg

SEQ ID NO: 1437 - DNA, 246 bp, Nicotiana tabacum
gctcatcaaaatgttttccaaaactaacctttttctttgcctttctttggctattttgctaattgtaatatcctcacaagctgatgcaaggcagatttctaaggcggctgctccaattacccatgcaatgaattcaaacaacattactaatcagaagacgggtgccggaatcatccgtaagataccgggttggatacgaaaaggtgcaaaaccaggaggcaaagtcgccggcaaagctgtaaaatt

SEQ ID NO: 1438 - DNA, 459 bp, Nicotiana tabacum
aaatagctcatcaaaatgttttccaaaactaacctttttctttgcctttctttggctattttgctaattgtgatatcctcacaagctgatgcaagggagacgtctaaggcagctgctccaattacccaagaaatgaattcaaacaacattactgatcagaagacgggtgccggaatcatccgcaaaatcgccggcaaagcttgtaaaatttgctcatgtaaatatcagatttgcagcaaatgtcctaaatgtcatgcccaaataatcgtcggcaaattttgtaaaatttgctcatgtaagaataagatttgcaagtaaatgtcctaaatgtcatgaccaaaattaggcctcagagactatgtacttgtgctggtgtgagtttagttttgagaataaagggaaagttatgaatagcctaatataattctattcactttcctctagttaatttctcttagt

SEQ ID NO: 1439 - DNA, 390 bp, Nicotiana tabacum
gaaaagatcactgttgttaagatagatcatgatgcaaatcccaagctcatagaagagttcaaagtttatggattgccaactttgattctcttcaaagatggaaaggaagttccagatagtaaaagggaaggtgcgataacaaaagttaaactcaaggagtatcttgatggacttctaaagacagtttctatcgcataatatttgggctaaagtttagtggttctggtatcttcatcagtttatgatgagatgcactttttgtctggtcaatgttagtatcctgaaattgcctgtaatttgatttgcttccttgattagccaagaatagcggggatgcattgtatattttagctatctctgtgggcgatgacctgtttgtatttgtatatt

SEQ ID NO: 1440 - DNA, 407 bp, Nicotiana tabacum
caacttaaaaccgtgggcaactctattcctagtctaatgggccttaaagaacttgctgactcctcaccgcaagcaatgaacagcatatatattacagaaattgctcaagatggtactgataagttattagagccacctaggcccctattgaggacggcctctattaggtgctgaatggcggtcattcggattgtttttgggttatattatacaagagttgaccatagctggttttcaccggtatactcaatgaatgtattcaaatctgaagatttgtacatgctgagataagtacatgctgctatgtggtagagtacaacaatattacattgttcatatttcactatctaattgtttggagatcttaactgttgtttcttcacaacaggggttctatatttctttag

SEQ ID NO: 1441 - DNA, 487 bp, Nicotiana tabacum
aaaaccgtgggcaactctattcctagtctaatgggccttaaagaacttgctgactcctcaccgcaagcaatgaacagcatatatattacagaaattgctcaagatggtactgataagttattagagccacctaggcccctattgaggacggcctctattaggtgctgaatggcggtcattcggattgtttttgggttatattatacaagagttgaccatagctggttttcaccggtatactcaatgaatgtattcaaatctgaagatttgtacatgctgagataagtacatgctgctatgtggtagagtacaacaatattacattgttcatatttcactatctaattgtttggagatcttaactgttgtttcttcacaacagggttctatattctttagttatttttgtacgttacagagatttttatcttagtttgatatgcatacctcgtcatgtatctttcttttacgctatttcttgcgttga

SEQ ID NO: 1442 - DNA, 357 bp, Nicotiana tabacum
ttttagcagagtaaactaaagtattatcttatttaaaccatagtcttaagattaaacataaactggtagaagcaggctaataccaattacagcacaaccctagaactagacccacagtaagcaagcagtaaccgatagattaaaattgaaaacaaagccaaaaacggcgacttaaatatagataaactagatcatcatcaacgtcatcagatctaggagagttgaccacagtcagcaaccacaacaggcttggagcaccttccagatccagatccaacagcctcagccttcttaatcacatcatagccttcaacaacttgaccgaacacaacgtgcttgccgtcgagccactcagtc

SEQ ID NO: 1443 - DNA, 458 bp, Nicotiana tabacum
cctgtagttacgtttattttaggtgagttttctgttttttttaagtattcttatgttaaaaaggggagcgtgctgcttcttgtggggctatttttttttattttactgtgcaattttcttggtctcattccctacgttttttctagctcttctcacttggtttatacaataactctcagttttccggcctggttggggctcatgctcttggggtgatgtcaattctctaaaagaatgttttctcatttaattccttctggtactcctcttcttttaattccgctaatggttggtgttgagagtgtaagaatacttattcgtccagtttctttggcggtacgtttaatgtctaatataatttcaggtcatcttcttataaggttgttgggtaattgtgggatatcttttattttaatacagtctgggtttttcttgtttgaggtgtttgtttgctttat

SEQ ID NO: 1444 - DNA, 402 bp, Nicotiana tabacum
ttttgcatcttacaataaaatttcatattaattaaagatagacgtaataattaaggtttatttgctcaaactatgaagattttattgtgaattacacaaaaattgtgcaactccttacaataatagcgttggctgcttgctacttttaggcactttcagcccaggtttccatcaattttgccatctggtccgcacctaatctggcacttccgatcgcaacgctggtactctctcagtggacgaccaacgcaggcagtattgcaagagtcatagcaattgacgccttgagcatcgacagtctccatgttagctgataagaggaggaggaggagcagcatagccatagctgccactcctatcattttcttcttcgccatcttaattacttttatgaagactgtc

SEQ ID NO: 1445 - DNA, 477 bp, Nicotiana tabacum
agttacttcaaaatccaggagagtttcatttacaacaacagccttcagccttgttagagcaaatgttgtttgcttcttcatcaatgggtcttttgcaatcacacacattcccctcttattcttcatcttcctcattagctacttcctctgcagcttcttcccctgcatatcccctgttttactctgctcaacaatcacgtttctttcagcccccacaaagtactcatcaaaatcaaactagtagcagcagctccagttttcctgcaccattttggactagttcaacccactacccaccttcttctagttaattttcatacttctttggattttagttttttcttgtgttttaaaaaaattaatcggtatccaattttttttgttttttcttttgtttggattttagtttttgattttctttgtgttttgtagttagcaggtaggggagataggaaataggcaaggactaatactggc

SEQ ID NO: 1446 - DNA, 419 bp, Nicotiana tabacum
ttttatgcaaatatagctattacgagaaaaaggatatgagaatgacaagaagacctattaaatacataaaggctgcacctaaggtctatacttcaacaaaagcttcctcaaactagtatggttcacgatggaaactgttttgctcatggtgccagaaaagaccttcaaagattggagaacctgatacttcggaataggaccaatctaaacagaggccagaatgaccagttctcacatggcctcagctctctttgatatcttcagagaccttagcttggatgatgacttaatagattgtattagagggacctcctcttcgtcatcttgtttttcttcatctgcgtcctggtcagatccactgattgactcctcgtcttcgctagaagtgtgcttgttaaacagcttttttccttgtaagt

SEQ ID NO: 1447 - DNA, 430 bp, Nicotiana tabacum
ttttaattaacaaacttatatgtaattgatatatgacacgtttctgttacattacaccccaaatcacgttacagaaatatatcagattgagaaacaaaaaggaaaagtgatcagaacacacaaacctaagaactgacaatcagttccatggctagctgtaatcttctccttattattacagaaaacacacacattattgtggaatcacaagagagttatcttaacaattgcaagggtcacaggtgcagtttgatccacatttgcagccatttcctcattctgctgctttctctccaaattcctcaaagctcttcatgggagcaacaccctgaatgatggtaagggtagtggatttctccaagtctgggtacatcccacatcctccgcagccactgccgcacttgcagccagatccacagccacagcttcc

SEQ ID NO: 1448 - DNA, 435 bp, Nicotiana tabacum
ttttaaaattcgaacttcatttttgcagtataaactacagaaatacaaatcccaatacgtggttcgaagcacgataataaagtgctgatggagtctaagacttgagttcacagtacatttactgaacgacatatttacacaaattaggataatgtagtaaaacccttgatcacagacaacattcctgggataagttccatctcacaggttaggattagtagtatgggcagcagtcacagtagagaccatggcatcaactccacagatattgtgacccctgcaaatcttgtaatatccatgctctccccagttctctccccatgaattcttgatgatccagtaagccttttccttgagtctgataggagcaaagccatgagaaccataacctactaagagcactccgtgatcctgacaaatccatcttaagggcga

SEQ ID NO: 1449 - DNA, 278 bp, Nicotiana tabacum
ttttgctaatcacaaaaaacaataaagactgaaaattaattacaagtactaatcatactgaggtattcattcttgcccactagatacaggtactaacgtatatgttgtctggaaaaagaattccagaataagtaaatcaaaacttgccgagaacacattgacataatctgataaactgattaaaagactgtttcaccagcagcattgcatcatctaaagaatgaatcaattggcaggtatggaataaagagaaaatgtcgcatttcactgctattgtc

SEQ ID NO: 1450 - DNA, 485 bp, Nicotiana tabacum
ggatgatacttcttttgctgattggttcaccgcggtgcaattggataaagcagcccctggttttgatgcggtgtattccttcaacggaactatattagacggcgttaacaataccttgttcatgcaaggcctggagggcttgaactatctagtagcagaaacagatggagctaatccagagaaagatccccgagtacctgggaaacaacaatcagtaatctcattcacaaagaagaatatccctggaatcaacattcctggcggtgatggattcccaacaaagatattctttaatggagaagagtgctcattgccaaagatactcccaacaagcagctcatctaggaggatatcttcgtttgctgtcactacatccatactagcacttgtggtttttatgttgatgcgacaatagcagtgaaatgcgacattttctctttattccatacctgccaattgattcattctttagatgatgcaatgct

SEQ ID NO: 1451 - DNA, 477 bp, Nicotiana tabacum
ttttagtctgtaatgcccatacattcagttgaataattaagcattgctccagcaatgtctctcaacaccatactcgaatgaagatcacatatagaagtacaagatatacccttggttttataaaaggaaagacaaaaggtaaaataaatttcacatatagatcacaagacaacaaaattggaataaaactaagcggatcatctctgcatcaatctcgtgcgtactttgaaagcaatattttcctgcatattccgtaggggtctagagaccataagatcgctaataaaacttcatcgaacttcagaaaactgcatcctttgctacaactatttatgattgcagaattttcttgtaatcctggaatgtcccgtcgaaaggcgtcaccctgccctcagagacggcccagagttgatcaacactaccagaaattaaatgttcatcgtgactgaccatcagtacgcctccttggaacaagac

SEQ ID NO: 1452 - DNA, 462 bp, Nicotiana tabacum
ctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgca

SEQ ID NO: 1453 - DNA, 430 bp, Nicotiana tabacum
gttggatctgtcctcaaatcccctcttatacatgatgcgttgctttccaggagtgcctgaacaaaaattacgtggtcatctaggttcatttggtatcactggaaatcttgctcttcagcccatgtacactattgtctggtggccaaaaaagcagagttgcatttgcaaagataaccttcaagaagcctcacatattgcttcttgatgagccatcaaatcacttggatcttgacgcagtggaggctctgatacaaggtcttgtcttgttccaaggaggcgtactgatggtcagtcacgatgaacatttaatatctggcagtgttgatcaactctgggccgtttctgagggcagggttacgcctttcgacgggacattccaggattacaagaaaattctgcaatcataaacagttgtaacaaaggttgcagt

SEQ ID NO: 1454 - DNA, 253 bp, Nicotiana tabacum
tacacgtgagcaaactggttaggacctgggacaaggttcaccgtgtgacagcaggatgcatctcacatctgcttgcaccccgtggatgcatgagtaatgtacgacagcctccacatatcagtagagccatttccattccaggaggtgggacaggggtgagtgcattgcacactgcacagcagacataagaagctcctctcggataaagaagaattgtcctacacccactgcacattaactgactctgcatatc

SEQ ID NO: 1455 - DNA, 456 bp, Nicotiana tabacum
ttttaccaattaaacgagacttcatgtttttcgtattaacatggtaaaaataccactaaaatagttttacaggcttaaaatcgtacaaagaattcaaaattactcaatacaaataacgaattcccactaatcaaacacaaatatgaattccactattgcacaagcaagtgaaaagatatcattaggaaaaacatttcctatcaatcctcccaacttacctcacaacaaatactacccaaagagaatcaacattcattcatcaagataatacagcagtagtactcttctttgttttcctgtttgcataaatcttagcatataagttcttggttctgatcgttagcagaatatctaatccgaatccaacgatgcaagctatagacataactatgaatactagcctgtagcagtgagcgccaacacaagtgttgccaccaccagctgtttttgtagcct

SEQ ID NO: 1456 - DNA, 437 bp, Nicotiana tabacum
tcacatgcctgagactcgaggactctgcctgtctgaagaacagaccattagcactatttcaaggcggccacggattggtagttatcggattttagatatgtttactgagccttacaggttaattcgacgatgtgaagtgacagctattttaatcttgtatggtctccctaggttattgactggttcaattctggctcatgaaatgatgcatgcatggctgaggcttaaaggttatccgagtttaagtccagaagttgaagaaggtatctgccaagtattagctcacatgtggttggagtctgaaattatagctggttctggtagtaatagtacttctgcatcttcctcggcgtcctcatcatcctcttcatcaccatctactacttcatcaaagaaagggaaacgttctgagtttgagaagaaattgggtgattttt

SEQ ID NO: 1457 - DNA, 474 bp, Nicotiana tabacum
gtgttgcttatattatggaaatgtataaggaaggaggactatttggtgaacttgcaagctcaattcaggttacagagttcacgataaaagatgcttatactctcaagttttttgagaacaattcaagccggttgccaaagtggtgcaatgccgatgacactgtgaagcttcctttctgtcaaattcgtggaaagtatcggatggaattacccggatacaatactatggatccgtatccccatatgaacgaaagatgtccatctatgcctccgaaatattacagacctcaaggttgttgacaagatttcccccatcttcctcgtagttattgttgaagacataaccaagtaaatacaagtgtgctatctctaacagctaaagcttttagatgagatggtcacacaattcaacaagcatgtcgcatagtataattttttcactcatcagttctcttggagttgtacaattgcctag

SEQ ID NO: 1458 - DNA, 365 bp, Nicotiana tabacum
aaataaatagcaaatatattttacatttcataaattccaaagcgaacctaaccacccatccagcctgttcaacccaacaccaaatcaacgccacaaatttaaaaaaataaaatcctaccccgagctgaattttggttcggcggctcaaaacctatcaattttatcagccttaactacagggttagctttagcaatctctgctttccccttaaatttgaaatcaaaggtacaatcatgctgctctgggtatctatgggtcccacaaaaggtactaccacatctgcacttgaaacccactacccctactttcttcctacaagtcaaacaccggtttgacaccgccaccttcgcctcactcccggcga

SEQ ID NO: 1459 - DNA, 586 bp, Nicotiana tabacum
tcgacctggcttatctagtcgggcgtttgggctgatcgtcaagtactcaagggttttgttgaccttttcctctgtgacgatggagtacctacgtccaagggacaggtcagactcacactgcattgatttgtgcaaaattgaactgcaggggatcgtctttttatcagcaccttttgaattctgaacgatgtccgaaatgttccaacgtgttttgccggtgctttttacctgaacgaagtcgatgtatccatcagatacaatgtcgatatcgtctgtgacctcgcagcgcacactgcggatagtcttgtcacgaagcattcgggtgacatggtaagcggctacgcagtcctgaaataagaaaccgtgcttggcggctactccgcctgaatcgttcgactccatttagacatccgtgacaattttgcgaaaattaaggagatgttatgacacagtccaatcggatcactgcatcatcaccagtgatctaaatacttcacagccattctcggtcgcaggtatcaagcttttcaggattccacaaatattgtaaccctgacgtctaatttggttatataacatactgccc

SEQ ID NO: 1460 - DNA, 276 bp, Nicotiana tabacum
tcatcttctttccctgtgacaagcagtcgtgttggtactgctgatcagtccttgattccctctgttactcagagagctgccagaaccaatgcagatatcccaagaccaggatcgtttgtccctccattccttgttagtcacggttctgctgctagagctggaagttcagttgcctcaccaatgatacctccttatcctggaagcgcagctcggacccgtgaccgcgttcaggctcttcaagcatattttcagcaaccaagtaattcaccagctgta

SEQ ID NO: 1461 - DNA, 490 bp, Nicotiana tabacum
  modified_base (94)..(94): a, c, g or t
ttttatttaacttctataacaacttatttattcacataatgagtgttctacatcagcacaagcaccacatctataatgcaaaaaatcataagangaaccagaactatttttccatgctttcagactcacctatatcaacatctaagatatggaaaatcttgagtctcagtctgctaagagctagaacactcacatgtcatgcagagactttaaaggacccaacatacacattcatggaaaaacaaaatcttcctaggaccttgatatcatgctacaagaacgagtcaatcgaactgtcaggctgcctccatctatggtagcctctcgctcgactggatcctgaacatactgcttcctgcacccggggcaacgcccatcctcctcaagaatcctcttgtgacaaaagagacaaagcctaaacccacatgaacaagggagaaaacttgtgtctgtaaaatccaatcttcacagcatataggacatgacgtgg

SEQ ID NO: 1462 - DNA, 417 bp, Nicotiana tabacum
ggaaatatgatccgtttatagttgtagaaacagaaggtgacaaactcgcaggaaatagaggtttcaatgatgttgcggggtacatatttggcaaaaattcagcgacagagaagataccgatgactactcctgtcttcactcaggcattcgatgctgaaaaatctaaagtgtcaatccagatagttcttccatcggataaatctttgagcagcttaccagctcccaatcaagaaggtataagcttaaggaaaacggaaggaggcatcgctgctgcattaaaatttagtggaaaaccaactgatgatgttgttcgagaaaaggaaaaacaactcagatcaagtcttattaaggacggtctcaaacctcaatcggattgcatgcttgctcgctacaatgatcctggtcgaacgtggaagt

SEQ ID NO: 1463 - DNA, 400 bp, Nicotiana tabacum
ttttcaataacaagaaattttttattcttatttatcagtttttgccttgcccatcaaatacttgaacattcccaattatagatcaagtctcctttccaccagagggccaatacaacattaaaatcaaaatttcacttggattttgccatttctagaaactgaaaaaacaataacctacaccttatggactcacttttgtcaaagcctatcctgataaaaatccaagtatgaagaacaagaaaaccttacgtagtggaaaggaggaacatgagaccccatttagccgttctcagcatgtcctagcctccttcaaatgcttagtatccataacctgaattgtccattgggtttccagcaaccacaggttcaggctccttgttctcagtaactacagcatctg

SEQ ID NO: 1464 - DNA, 294 bp, Nicotiana tabacum
agcagacaaaggagagaagctcaacagatgaagaaatttctgcagaaaaaatagcaaattctttgttgaacgaagccagaacattgcgcacaaaagataacacttccataattttcttagattttgacaccaccaatagaattctttcttgtaaaattgattcataggattgacttcacaccttcatatatttagtattacagtgatgtttatctctctctctttttttttctgcaattgaagatcagttaccttctgttaatattagtgcaacccctcatgttattgacaaaa

SEQ ID NO: 1465 - DNA, 406 bp, Nicotiana tabacum
tatcaatagcataaagtccatatctgtcttgcgggacctcaatgcttgtgtcagggtctaaattggcagttctaccagtagaagggtcaaagcgacaccataacttgtcacaaaactcatggtcagcaccaaggattcggacccaaacccgctcggttcgacccgttttcttatcagtagcgttgaggatcgatccggcgatacccggaaccaataaaaccgggtcaagggtcgggtcaatgtactcctgaggcttcttaatcagcttcagccacatctctattgacttcaccagctcctctaataacaccgccatctcccccaacgactaaaaaccctaataaaatttaaaggtttattagacgaaattgaagaaaaaaggtgtatatttttggtttgattggac

SEQ ID NO: 1466 - DNA, 468 bp, Nicotiana tabacum
atcgccagctatggtgaattatagtaactaaaggtgccttgcatcacatatcatgtcaatatgtagatagtttatatgtaaatagataactctcatgtctttttttttttgcaagcacatatcatccctgaattgaggggattgagcttgctgtcaaagcataaactcctggaaaagctaaatgaagtctctgatttgtagtgcagagtatgcaacattgaactcgattggagcaaaggaaagaattgtacagatactttattttcttctttttttctctttcagaatatagatacttctcttagctagaaagaaattagatgtactaaatcaaagtcgtaaacttacgtcgacaaatatgctatgttgtcattgaacactttagaactgaagaaataggaagcttgtcgttatgtatagtagcattcaagtctcaagtcaaaaacaacaaatagtaaatccagtatt

SEQ ID NO: 1467 - DNA, 387 bp, Nicotiana tabacum
gagctctctttaatgcagctactgcagcttcctcggctggaggaatatatgcaccatagccaaggcgtggatatagccatcgtgcaatgtttgcatcaatctcagtggcagaaaaatcattccattgctcgatttgagcatattcaatcaatgatgaaccaaaaaggggattgtcgggcttcgatttagtaacatagcgtgcaatagcattgctctcgaaaacaggtccatcgggtgtttcaagcacaggaacctttccaattggattcatcttgataaactcaggtgtcttgtttgatacacccatctcgaaattctttgcaagttcaacctttacacctgtgtactcagcagcaatgagtgcctttgaggcatttttgttgttat

SEQ ID NO: 1468 - DNA, 244 bp, Nicotiana tabacum
ggcattcggagcgtcgatgatccaaagagtttcttctctgtaactttttattgggtggttcctgggaggagtatttcaccttaaacaaacactgcaacaaataccaaatcacagaaaggacgacgaacaggactcgaaagtaatctctcattcccctggtacaattcacctacatgcatgtgatggcaactgctacctaaacagacgcatttgcagcaagagcagcaaggactttccacttctg

SEQ ID NO: 1469 - DNA, 387 bp, Nicotiana tabacum
ctgtcgccaatagatcttgacattgcaaggacgccaaaaacacgatgtccattccactgaatgaccttgccaccagatgcttcaattctagcatactcatcttctctgcttggtttatgatcaattgacagtgccattgcttctttgccacgataaaggactgctcttgaatccccacaattagaaactacaatatgagatgaacatatcaccgctacaactgcagtggaccccacagtttccggggcaataggttcagaggcgcagctagtggtatctatgttgtcttcaccgggatcactgtttactttccccccaacttcatcgtcaaccttgagaaagcaactagtaaagaccttctcccactgcacctgacgtgtgtccttt

SEQ ID NO: 1470 - DNA, 267 bp, Nicotiana tabacum
gacgatagtttcctgtaggaaactgctttgattgacttcgggaaattcatccttaatgtacaaaagtgcaccagatattactcctgtgtcgtagccgaaaaggagacctccaataccggcaacgaaagtcaaacccaagacatagggattgctgaagtaagacactactttcctattactaacatccaagtaccctgaacttcctggtaatgaaacaatcgtcatctcttctactccaaataattatttcaatcaaaaatctcagag

SEQ ID NO: 1471 - DNA, 258 bp, Nicotiana tabacum
gagttagttcgactcatagaagttccatgagttgcaaaccaattaaagctgcctactggaccccattcatcatcaacaaactttaaaagggtcatttctttgtcaacatcatacttatatttactacgttccccagcagggttattcaaataagcactagggctacgattcacaccagcatccagtagctcccctttattgacaaatattgatccaggtcggaggttttcatgagcttgtatgatactttgctcaatc

SEQ ID NO: 1472 - DNA, 413 bp, Nicotiana tabacum
tgggagaggagtcctacaaggatagcactttgattatgcaacttcttcgtgataacctcactttgtggacctcagatatgcaggatgatggaactgatgagatcaaagaaccatcaaaagcagaggagcagcagtaatgtgagtgaagcctctttgcttaggattgaaatcctatggactttgctcattgatcgaaatttgctgtttgtgtagttctgaattccctgaattgtaatacctaaaagcactgtttcttgccatttgttgttttcagcaaagattatttttttccgcagtatttcccttgtatttggatgctccggtgaaactctcttattttcgtggaaatgaattcttgtttttacggagcaaattatcattttgtatttccattttctctaaggaatgggaga

SEQ ID NO: 1473 - DNA, 412 bp, Nicotiana tabacum
aagacaagaagaagattgaggatgccattgaggaagccatccaatggcttgatggcaaccagcttgccgaggctgatgaatttgaagacaaaatgaaggaactcgagggcatctgcaacccaatcattgcaaaaatgtaccagggcgctggcggcgacatgggtggcgccatggatgatgagggtcctgctcctagcggcggcggtgctggtcctaagattgaggaggtggactaagttggtgctcctatattgttttttatttcttaattagagacctgcaattttattttaaagatctatgtggctatgatttttgcttagtagttgaattatattattttcattctgcaatcaagtactgctatcttttatttctcggttttcatcaaatgtttgctcttccttaaaaa

SEQ ID NO: 1474 - DNA, 266 bp, Nicotiana tabacum
ttttcaatcaaacgagattttttttattttatatatataagtaatataatagtaagaacacaacatctgaccatagacttagtattacttctctcctaaacttaaggagctaatttaaaatttagaacattaattaaatgaaacattttagtaataatatttttcttcgtcatcatcagtaatccttgagtaatttccggacctgttccagtgtaacaaagagcacaatagtgaatggtccttgccttgagattgtagggatgtaa

SEQ ID NO: 1475 - DNA, 426 bp, Nicotiana tabacum
ttttctgaagtgtcgtactcatgacattatatattggggccgtgttattcaacatacatatttactgcattgtcttctctaatactcaatactactactatactcaaaccacaacatcagagcaccgttgacccgtatcaattgtttttcctgcccctgattaaattaacacactaatcgtaaatctataaaatgtgggctcaggcccaataaagcctaataaatggtgaattaaattagagcgacatcaggaatggattcagtatcggcaacaggcaaattctcgccggagatggacagtttcccgtcggacttggtcttcttacagttgtctctaatggccgtcagctcataaggcgacgcatcagtagcaagccactgttccacttcgaaattctgttgggtgcaaacggaaagcctccttaa

SEQ ID NO: 1476 - DNA, 307 bp, Nicotiana tabacum
ttttctcctttaatttcttttgccacaaaaatttttgagagttaaaaatagtagtacaacaaaaatctacaagagcacaaaaccttcctttcaccccatccctccctactaaagaatggtataaaagaatggcagaattcagctgcacataaactttacatgttttacattttccctgtgggacccttccaagtatgtttactgaatctatcattacactataccaactccattaatagggggtcacctgctgccataactctgatcagctttatgaactcttgctcacttgatactttccagggat

SEQ ID NO: 1477 - DNA, 467 bp, Nicotiana tabacum
tttaaaatagaaactttctcattcaataaatattaacataagtgttttaagaaataaaaagaaccacaaaagcgcgaatccagataaagaagaaaatgagagaagacaaggaaaaaaaaacaagacaatcactctcctcaaactacaaccaacctagaagagaaaagacttcgagctggggatggtgccaggccaaaaaggtcactgcaggaggcacctcacaaatatgctgagaagataacccaaattgagttgaaacatgagatacactggcaataattgtttgttgccctccattcatagccccacctccaaacttatccatcccagcaaaaccacatttactggggacataatagcaaaagcgggaaaacaaataggaaacttgcacttttaagtaaaaataacagcaccttaaaagcacttcctgtgaacaatggaaggaccagactcatcatactcaccct

SEQ ID NO: 1478 - DNA, 325 bp, Nicotiana tabacum
gtgccaagtaaggctccccagaaccagctgtctaagctcgttctctatttcgtccatacttatatgctcaatgatggcaatcatctcccaagactctttttcaagggctttcatgtattagaatcatctgaaaactttattgttctttttaagagtgtaaatttagatgtctcttctggtgttttacgcccttggtctttcttgactttgacatgcatgaataccctttcccttcataattaggcgttaggtccatttttgatttagttgtgggatcagttttgtttttgaattttattaaaaacaattttgttcctttgcaaaa

SEQ ID NO: 1479 - DNA, 428 bp, Nicotiana tabacum
tttttctcattttcactacgtatatcttcattttccccattttcactacttatatcttcgattcctccaaaacccacttccaatttcgagtttcccacaacagccacctcaagatttttcccattttcactacttatatcttcgattcctcctaaagccacttccaatttcgagtcttccacaaccacccacctcaagatttttcccattttcactacttatatctccaattcctccagaacccacttgtaatttcgagttttcaaacacacccacatcatttttcccgtcaaattccccaaattgccgatcctcagacctttcactaccagagtcaatccaggtcggattatccgattcctcagaaccgttaaaagcagccaaaagtaggagtactgtgagaatctatggagaaatacctcgtgcga

SEQ ID NO: 1480 - DNA, 415 bp, Nicotiana tabacum
ccagagagattcttgctacatgtctatccaggtgaaaccttgatcacagaaatgtggcctgaagcctcgagagtcatatatcaggtgaaggttaaagaacgcaaccgggcagtgcttgtgggatttgtagatcttgatcgtattagttcgtctctgtaaattctcatggtgtttccaaggacaggacaccttaattatttaagtttgtattcctatatctaactaaaatacattcttgtactcaagcaatagatgttgaggatcaatagcctatggcaactagctaagaattaaggcatgatttttgtaaatatgtgtgatcagtgatgggcaataatgtgccagacacgttcatgtagactagtatagtagaaaagctggatcgaaaatatttaaaggtattttgagactaaaa

SEQ ID NO: 1481 - DNA, 317 bp, Nicotiana tabacum
gttgaagcaatggtagccctggcgcttgtggatcagttaatggctcattatgcacagtgtatgctgttcccaattaatcctgcattgcaggaacctttgcagtcatcgacacccgagtcagctgaggttaccctctgaatggagctgagcagcttttatgtgtaatttttatcaacaccttagtagttttactgtttagaggagacggatatctcctttttgcctctttatcactcatgggtaagccgggacctatcttaagtgcatttacgtcaatgtaaaattgtgcgccattgattaggcaattttaggttttt

SEQ ID NO: 1482 - DNA, 409 bp, Nicotiana tabacum
gatggattatttactgcaaaataagagcaacccaactacaggaaataatacatgttcgtcgatggaatcaatagtacccgtaaaatctcccactcaaggaagcaatacagtcacatcatcatcaggccgtgagagcagccaggcagaagtggacgaattagaattcttgaatcgttgtcgagatgctggggttgtacacattcttggaaacactgtagttagagcaaggagagactctaggttctataagaaaattgctatcgactatatatatgcgtttcttaggagaatatgcagggaaaatagtgtgatcttcaacgtacctcatgagagcctcttgaacgttggacaaattttctatgtataaatatttttgcaaatgatcaatcgaggatattattgactaaaa

SEQ ID NO: 1483 - DNA, 370 bp, Nicotiana tabacum
  modified_base (262)..(262): a, c, g or t
ttgggaggcgatcatgtcctgaaaatgggtatcggtggcggcgcatcgaaagccgcacagacgctcagtgactactacatcaaacgtgccgaacagtatcacccggtgataccgattggtgcgggcaacgaagtgaccgtggtgttccaggacggcttccagctgaaaaccgtggaaaagatggcgctggaacgcacgcagagcagagcggaagaagacaatccggaaagtccggttcctgttccgccatcggctgaaagtnatcttaacggctttaatactgaccagatgctgaagcagctgggcaacctgaatccgcagcagtttatgtccggcagcagggagggggcaacgatggcaaataatatgt

SEQ ID NO: 1484 - DNA, 462 bp, Nicotiana tabacum
gggtgattctgaaggttcatccagatttgaaagcttgtccaaccaaaggatcatcctgttgtcaagattatgggagcaagagtttctgatcaaaagaaagctaaatgattttaattgaagcacttgtgtgaaagcttattatgaaaggattccacagctggggacgttggcattggtagctgatgtaagttattccgtgatcgtgttcatttgtgctagttatataggatgattaggtgatattatctcaatttttggaatctttattaggactgattttatgccctttagatgagtatgttgaaatttttgggaaacaagagggagccctcatgatttgaagtggcttctcttcttgagtgtcatcagtaactgaattgtatatcaaattgctaatgtccaaataattttgcactactgggctgtgaaatgtgaaacttcatgactttctctgcgcaaaaa

SEQ ID NO: 1485 - DNA, 435 bp, Nicotiana tabacum
actgctctgagttcctgttgaattatgatgagaggaggttcaactgctgcatggaatactgtcgcgagggcaaaatgacctgtcctgttgaggctgcaccttgaagaaatggttgccctaaaattatcgcctcatcaaatggaagtacactgctttttctacttccggtgtttagtagtagtagtaaataagtgaggcatgttacgtactcttatgttttgtaataattatgctttttaataatgtaatctgtctgtgtgcatacaatgcacacgacgctagctactactttttatctactaaaaacgaaaagtaacttatttctgatcgctgaatacttatgctcggaaagccagcattctctagttagaaactagaattgtgttaccaattaatcatatatatttaaactgttacatagatcgattatttaaa

SEQ ID NO: 1486 - DNA, 515 bp, Nicotiana tabacum
cggaggagaatgtgcccgcgaacttagggttcccggaggctgtaataacccttgtactacattcggaggacaacaatattgttgcacacaaggaccttgtggtcctacatttttctcaaaatttttcaaacaaagatgccctgatgcctatagctacccacaagatgatcctactagcacttttacttgccctggtggtagtacaaattatagggttatcttttgtcctaatggtcaagctcacccaaattttcccttggaaatgcctggaagtgatgaagtggctaagtagagtggctatttctgtaataagatcaccttttggtcaaattattctatcgacacgttagtgtaagacaatctatttgactcgtttttatagttacgtactttgtttgaagtgatcaagtcatgatctttgctgtaataaacctaagacctgaataagagtcacatatgtatttttgtcttgatgttatatagatcaataatgcatctggattatcgtttttaaa

SEQ ID NO: 1487 - DNA, 381 bp, Nicotiana tabacum
gggaggaggatgtgtcccatgttaatcgtaccgactatcagctgattgacatctctgaagatggttttgtgtctcttcttactgaaaatggaaacaccaaagacgacctcaggcttcccaccgatgaagccctgctgagccaggttaaaggtggatttgaggaaggaaaggatcttgtgttgtctgtgatgtctgcaatgggtgaagagcagattgccgctgttaaggacattggtaccaagaactagtcgcgcattctgcagcataaataatttgctttagccaaggcattttatatcttaatcgtggtactttgatatccgttgattatgaactcgacttatatcctattggcatggcttgaatagttgaactttaaaa

SEQ ID NO: 1488 - DNA, 371 bp, Nicotiana tabacum
tcagtgatcttgaagaagatgattcagatgtgcccgcaaattcaaagaaagtaaattacagttctgataaggactcacgagattgggtccagttgaggaaaagctccagtgatatcagctctgtgaatcaaggtggttctgtcaaggaaaatgtgcagaatcctgatagcaaagaatcaaatgattggctggatattgatgacattgaggtggcatgaccttatgtaaggtttaaatatagttatttccgctcatttattgttgtgaatagttgttccctatcctcctttctccgctcctgcgactaagaattctcaactatatgtttgtacataaaatgcataatgaataatagttgggttgctccctaa

SEQ ID NO: 1489 - DNA, 408 bp, Nicotiana tabacum
gtgtcctctgggtcgagtagagtttgagttcgtcgtcgaatttgagtttctccggcgaggtcccatcgaggttgtcgccgtccaaggttttcggtgttaaaacattttcagattcaaagagcttttgactcctaaggttctctcttatctctttgactaatagatccagtaaaggtcaatttctaactcttatgccttaaatctgttattgtttgttattatgtgaatgaatttgggttatcttccctgaatgcactctgttgatatgaatttcacatgggtttgtaattttctttagatttcatttcattcgtatttttaattagttgatttagagcttgaatgtaactttaagactaagtgaagttgatgtttgaattaagtggttttgtaattaggatacgaaaa

SEQ ID NO: 1490 - DNA, 421 bp, Nicotiana tabacum
aagaaatccagtgcagtaatcgccgagatcgatagactcaacgagaatactgtaggcgttgatctggaatgatcaggggcttcgtagccgcccgattaaccactgatttgacgcttctgttgggctaacaccaccacgtcatttctattttttttcttgacttgtaattacagaaagtcatttctacttttacttatccaaatcttgtagtcggtgaatttcgtaatatgattaggataagatttgatttattctactcaatctttagacggtttgacaaatgtactttttactttgtgtagtttaatttggataatgttaaggaatacctggcacagttagctgccttccttttccatgtatttcaagaaaatttcaaggtttctaagcattttaagataataatctttataaaggaaaa

SEQ ID NO: 1491 - DNA, 259 bp, Nicotiana tabacum
acaattttgcgatgcatccggcgaaacacattggtgcgcataccaaaaaggcgagggcggggatcgtagtagcggaacactacgccagctgccgtcagttcattgacaaactcatcgctgagatccggcgaaccgtagccatccagcaagacttccgctttaaccccgcgttgcgctgctgccagtagtgccgcatgcagttgtttgccgacgtcatcctcaaaccagataaacgtttcaagaatgatgcgttcttgtg

SEQ ID NO: 1492 - DNA, 438 bp, Nicotiana tabacum
gttctgtttgagtggggatatttctccgatcacgaaaacagcttcccgcaagagctgctggataaactggtcgaacgcgctaatctgccgggttacctcggtaactgccactcttccggtacggtcattctggatcaactgggcgaagagcacatgaaaaccggcaagccgattttctatacctccgctgactccgtgttccagattgcctgccatgaagaaactttcggtctggataaactctacgaactgtgcgaaatcgcccgtgaagagctgaccaacggcggctacaatatcggtcgtgttatcgctcgtccgtttatcggcgacaaagccggtaacttccagcgtaccggtaaccgtcacgacctggctgttgagccgccagcaccgaccgtgctgcagaaactggttgatgaaaaacacggccaggtggtt

SEQ ID NO: 1493 - DNA, 353 bp, Nicotiana tabacum
cacatgggagactgtcaagagcctcaagcctaaagcttaagtgaggtcttgcattttggccattatttttcttgcagaccaataaacaagcttcatcatatcatgcattgttggcaggagaagggaatttgtgtctccattgaggattctacgagctcttgagtcattgaacatttgttatttttctttcttttttcacccttttctgcagtaccttatttttatgttgttactgttaagtagcagtaagtttccctgttaagtagcagtgaattaagtttcccttgttctatcaaaaaaaaaaaaaaactcgagggggggcccggtacccaattcgccctatagtgagtcgt

SEQ ID NO: 1494 - DNA, 356 bp, Nicotiana tabacum
tcagcatgacaaaaagccaatcacaaaaagtagttccagcatgatgctctcccaaatatgaaatctcttgctggcattacaagaatcatgccaaaaataatctattgatttaacagcaaaacgccccgcgacggtgcgcagggcgtggtgaatttgactactttttggtgaaaagttaacgcttatccgccaccagtttgagcgcgtgttcccagcacattaatgtctgcacccgctttatgggcattttcacttaaataacgccgccactgccgcgcgccaggaataccctggaacaagcccaacatatgccgggtaatatggccgagatacgtcccctggctgagttcacgctc

SEQ ID NO: 1495 - DNA, 375 bp, Nicotiana tabacum
aacagcgctgttctcgggtaatgaatggggcatccataccgaccagacaaataatgccatgcagataaaacgttccagttggttgcccttttggggaaccaggataggcaagcggaaacgccagcggcatggccagagcaggggaacaccggcgggtgtcagcatatcggcaagtatgtggctcaaataacccagcaccattccttgtagcgcatcagccggaatgaaccagccttccggaaccttaaggtaaaaggttgccagcagcgcaaataccgccagcagactgtgggtaaaaccacgatgcccaaaagcgcgggcgatcggttttgatatccattttaatcgctgcccaagaaacgactttgggtgatc

SEQ ID NO: 1496 - DNA, 360 bp, Nicotiana tabacum
ttttaaaaccacaaacaaaaattaacatgttttttcacagtagtggaaaagaacttcacatcaagctcttcaaaaaaaaactggaaataataattcccaaaaactaaaacaaaaaaaataagtatttaaaaaacacctcatcacgaaattccatgtcatcatcatcatcatcgccagccatgtatattcattcattcaccttaaagagaaccagtcaagcacatcccaagcaacgcgccgctgcgcaaatgccacgcgctcatcggaaaccaacggcgaccggcaaataggacagttaaaattaaacgtatccaaccacccgtcaaaacactccttgtgaaaaacatgccagcaggccaa

SEQ ID NO: 1497 - DNA, 318 bp, Nicotiana tabacum
ccgaatatataaaagaagctaacagtggaggctatttgcagctgaataaatcattttgaagtacagattacagggatatagttttcagaaaattccctgttattttcataaaccaatgcttctgtttaagcattggtttaggaagttctatagaacgctgctgattggattatgtgattgaagaaattgtacagcttccaaataccaatggccagtatgattttgtatttagagtacaaataaagctcatgtatatgtacaactactatttgttgatcacaaggttgtgaaataatacaagtttcattataaaggaaa

SEQ ID NO: 1498 - DNA, 507 bp, Nicotiana tabacum
ccctaacagatctaatgtgcccccagaggaattatatgctactcagctaactcagttacaagaaatgggtttctttgacactcaagaaaatatccgggcactgattgccactgcaggcaatgttcatgctgcagtagagcgacttattggaaattctggacagtagtgtcagtatttgactataggacaacacagcaactgatggctcggtgaattgatcgattttggacacaagggagcgtcatatcatgctggagataaatattcaaaattttagtacttggatccgcgtctcatcgtctgcccgttctcttttcacttggactaaaaaagaaagtgatgaaagatctagttcttgagttccccatacatgagatgttaaagtcagtttcataattagtttaatataatgttatctattctccgcctccatgcgacctcagattttctggacactatttaattttcagccatagtcatatatctcagtccactagatttattaaa

SEQ ID NO: 1499 - DNA, 356 bp, Nicotiana tabacum
ttttatccaggattaacgaataatatatgtaaaataataattctcataaataaccgtgtagttctatatccatatttcgagcttcacactttctctactactatttccaataatacccaaatggtaccatctcaaatgaatcttgagcagaaatatagagaaaaagttttaagagaccaaaatattcaagggtatatttgttccaaaagtacacctctctcacctcccaactcctttactcaacatttccttgtacctaataatagaatcaagcctctgtaacttcaactgctgcctaaacttgttaataaaatcatcagctttctcattaactgcttcatcttctccaaacgacg

SEQ ID NO: 1500 - DNA, 259 bp, Nicotiana tabacum
ttttgcacaaaaattaccttttctataaatgcatatggaacagacttatataagaaaattacccaaagctgacgaccctgctacttcagggatcagcaaaggaagaactaagtacactttgagaaaaacgagaaataacactatataggagtgtacgtgtaattgacttcttgcctctagccgtgaaaagcggcaaggctgttgatcaaagccaaggcattgctcgtcatatgtgcaacgtccagaatccttcccctta

SEQ ID NO: 1501 - DNA, 335 bp, Nicotiana tabacum
acttatgcattgcaagtggaacacctaacaatggcacatttaatccagggtttcaattacaaaactccaaatgacgaggccttggatatgaaggaaggtgcaggcataacaatacgtaaggtaaatccagtggaattgataataacgcctcgcttggcacctgagctttactaaaacctaagatctttcatcttggttgatcattgtttaatactcctagatgggtattcatttaccttttttcaattaattgcatgtacgagcttttttaatttggtatatttgtaacaataagtaaagaatgattgtgctaatatataaagatttgcagaaaa

SEQ ID NO: 1502 - DNA, 267 bp, Nicotiana tabacum
tcctgcgcatccggatattaaacgggcgcggcggcaggttacccatcaccaccgaggccagatactgcgaggtggttttgcccttaatggtgatgtctttttccgtcacccagccaccgttacgttgtatctgaaccagcaggcggacttccgacggattcctgtcaccctttgaggtggtttccaccagcgcctgtacaccgaaggtaaagcgcagtacggtcgatgtttgcagacgtaatggtgcgggtgatcggcgtgtcatat

SEQ ID NO: 1503 - DNA, 247 bp, Nicotiana tabacum
ttcttgtgatggtgttttatagtaatagtgctgtgtgcctgattacacctggataagtttggtgagaagcggtttatgtatgtttgccagtttgtttccttccggggtgatacagtagagtgttgggaactgcatgttaaataaatgttgtggttgtgtttgaaatagctttcactgactagcatttgctataaatataaataaatggtgtgatgatgttttaaatagttttctttgactagcaaaa

SEQ ID NO: 1504 - DNA, 334 bp, Nicotiana tabacum
ttttaatacgaacctctttcattatacttatacaagagtatacaagtacaaaaaataaggtatgtgctaaggaagtttgcacacacaaatctaaaactaatatagtaacatttgcaacttcattattcatgactaagacataacatcaagactcccgattttatagttgtggttgttggcttgtcaatatataataatgttattaaatggctaatttctcgagtcgaggtctttcgaaaatagcctttctacctttcaagatagggggtaagttctgcacacatattgacctcccaaaaccttactttgtgggactatattaagtatgttgttg

SEQ ID NO: 1505 - DNA, 461 bp, Nicotiana tabacum
tatttgaccaacatcattaattaactttaaactttcaaggcactctagcttcttgacattgttgaatagtgcagactcgtttgactcaagaagcatacctatgttgccacgaatgcccaacttcttcatatttggagccctcacaaacacatcttccgtgcaactttcaggtgcaattgtcgaaagagtttgtaaagcttggtttaccagggcagctttactactttttggggcacgtaatatagcagaagcattagtgtgaagatgcctcagtcgtggcatgttcaatatgtctgcttcaatgtcaagagtcctctgttgtgtgtcaacaataagagtttgcatgttccaaagccctcccatttgtccctcgtgccgaattcggcacgagggaagaatcctagattttcctcaatcgaggtttataagattgcagaggagatggcttgcagttttggacc

SEQ ID NO: 1506 - DNA, 269 bp, Nicotiana tabacum
acggatcaagcagatcgacgagctaactatcagaaggtaatttaatcagcttcctgctctaaggatgagaagccaattggagttatcttttaagagattgaagaatgttgttgatatatattcagttactaatttagcaatttttggctctctataggcttcatgtggagtgatgaaacttgaattctgtggatttatactagttccaaattgtgaaatgtatatcagccattgtaatcaatatgatctatattgttttgatttcaaaa

SEQ ID NO: 1507 - DNA, 301 bp, Nicotiana tabacum
atggaaatgaggaaacagaggattggaatataggaggattactacatgaagtatgttgatatatagggcaggttaattagtggtgagtctatagcatattttcttgaccttttttcttcttttagcaaaattagtatggagtctaggtttgttgtaatggctagagggttactgaaccatattatttgttttaatttccattaaaattcactagggaattttaaagtttcaagctatactttttgcttcttcatttgcatggttttggaaatgatgaaattttgtgtattgagacgaaaaa

SEQ ID NO: 1508 - DNA, 269 bp, Nicotiana tabacum
tttagaaaacagcatttattcacctactatcttagggaattgagcagacaattgaactcaacaataaatatagtacaaattacaccactaaagatacaggctgtagaacaagaagaacctagtgcctaaataatatcacaagctcatcatatatgcacacaccacgcaaaactatggtacagacacaaaattagcagatatttaacctgcagctgtggtacataaaatacaacgcatccgcgggacaagctcgtctccaagggcgaatt

SEQ ID NO: 1509 - DNA, 305 bp, Nicotiana tabacum
actgatgctgaggtccaatcaagcaagaaaaagaacggatcaagcagatcgacgagctaactatcagaaggtaatttaatcagcttcctgctctaaggatgagaagccaattggagtcatcttttaagagattgaagaatgttgttgatatatattcagttactaatttagcaatttttggctctctataggcttcatgtggagtgatgaaacttgaattctatggatttatactagttccaaattgtgaaatgtatatcagccattgtaatcaatatgatctatattgttttgatttcaaaaaa

SEQ ID NO: 1510 - DNA, 215 bp, Nicotiana tabacum
ggagacgagcttgtcccgcgacaatgaaatagaaggatgggctcaccagaaaaaggaaaaaaaaaaaagatcaagaggaaataatcgcctcaaaaagggaagggaaaggagtaactttattttcagatttgaccgcaatgcgaatgccaatatttactatttcataaagtttaagacacaattacttaaagcttattgaaattctgggatctaaa

SEQ ID NO: 1511 - DNA, 186 bp, Nicotiana tabacum
ataaaaataatacatttggtgtcaaattatttcaccaaggcaaagtattagttccacatgttttcaatagcttacttatctttcactggaacactcatttctgtgaaatgagtttacatataatttgatgatgttaagctatttattccctgtaatggtaaactgatactccatatttctgataaa

SEQ ID NO: 1512 - DNA, 318 bp, Nicotiana tabacum
acatcaaaggtatgattgtcggacatttccacaaatcaaactcggcagtagtgtttgttggtctggcgatgaacagttagtttgagaagttatgtaaagagatggtgggggaaacacgagtgtaggctgtaggtcttatgtttgtagttcatctaaagaattgtacgataaatgcctaatttctgtagcttttgaaccccgccttacgagattcaggaaataaatgaagaatattgagcattgttacttagcgcaaaaaatcattgtgaacataaatgtaatagatcagtaatgtagcaatttatccttggtttaaaa

SEQ ID NO: 1513 - DNA, 196 bp, Nicotiana tabacum
ttttacttaaataattctgtttcatagaaacttaaaaaacacaaaccctgtaaaaatgaagccacaaacttgggcatcatatttactgtatctattttttcctataccaactcaatctctacccattttgttatgggccgcccatcttctctgcgccgggacataatttagacatataacaaagcaaggtaaggtg

SEQ ID NO: 1514 - DNA, 247 bp, Nicotiana tabacum
ttttgcaatagcaatatatcatttagtacccgaatattcagatcaagaactgtttcataagctgtgagttgattacttaagttgtaaaatatcaacactgaaactggaagccaaatgcacactgcatccctacaatgacaaatttcttttttcccgtcaccaagtaggttttatttcctggaattgcagattctagctggtgatctacgcccccgtcaagggcgaatctgcagatatcatacactgg

SEQ ID NO: 1515 - DNA, 194 bp, Nicotiana tabacum
acccaggagtctacaggcaattccagccatttgcaggagacagtagacactcaaaaattcaaaatgattgtccacattggtgcttgcctggtccaatagattcttggaatgatttaatgatggaaattttggtcagcagttgaaatgggaattgcatcattcttttctttcctcagagaactgttttcatctgc

SEQ ID NO: 1516 - DNA, 364 bp, Nicotiana tabacum
ttttgaaaaatgcaagcacaactatattattgcagcatgagatttattgataagatttagaagcataaatagcaattgctttcccactttatcaattcagttaaaaataaagatttaaagcatttgcagcacacacaagctgagatgacattcatcaacaaagaaatgtatactatttaacccaaacagaattcttccatttcgatgctctcctgaatccttctaatccaagaaacaactgctccttcagcgcgacaacgttcggaagacgaggtttcctcctccattttctacacagtgggtaacaacaaagaggaacagcaagcaaacaccatgtttgtgccaaactaattttctggtgttg

SEQ ID NO: 1517 - DNA, 215 bp, Nicotiana tabacum
  modified_base (156)..(156): a, c, g or t
ttttgaaataaaacattttacctaccataaaaggttaaaatacattatcagcattaaaacattttatgttgtctctatatataaattaattctatagtgaaccacatggcaactccaaggaactcataattatctcccccatcttcagatttccangagtatacaatggtgatcgacgtccccgtccaagggcgaattctgccagatattcatca

SEQ ID NO: 1518 - DNA, 336 bp, Nicotiana tabacum
ttgagagctcggataccattgacaatgtgaaggcaaagattcaggataaggagggtattccaccagaccagcagaggctgatctttgctggtaagcagctggaggatggtcgtacccttgctgattataacattcagaaagaatcaactcttcacctggttcttcgtctccgtggtggcttttgagaattcagtgttgtggctcttggaactattgtctttgtttcgaccctttggttgaaaaatgtttttagacttgtgtgatttgttttgatgttcgcttgtttttatcctgtctgaacactcgtttctttaataaatttagcttccagtaaaa

SEQ ID NO: 1519 - DNA, 371 bp, Nicotiana tabacum
ttttgaaataatctttaaggtagaacaaaattcagacaaacacaagttaaaataacaaaaatacgaaaatctaacttgcaatggtccgagaatcctgaagaatattcttgaacaagttggtccataagaccatacctttttccatgactataatatctatccaacttaaggtggtaaagtacttcgcatcgaacaatctccaatcgagagatttacttgggaccaatatccttcagggcacaaatctgctcctcacccatggctgacatgacagacacgacaaggtcttttccctcagcaaacccatccttgatctgtgtaaggaggttgtcatcagtaggcagcctaaggtcatccttggtgttaccatt

SEQ ID NO: 1520 - DNA, 354 bp, Nicotiana tabacum
tactgccatgtggtgagacagagatcgataaggcccacaaccgtaggtttcactgctcgttcattggcgagaacgaatcctttggaagataggaaagaagggagcagtagccacagataaccactgttcaaaagttgggaacttgctcattgtacatgttttccgagctggttctgtacacaactacatacatggaggctacatcgtcgaggtccagttgacgcaacgctgtactactgtaccatgtcttaaatgggcaaagatgcctctcaagtttgtaaattttgtactggtaatatagtatgtaattctttcattctatacctagtaaaattgttgttgttgagcactaaa

SEQ ID NO: 1521 - DNA, 231 bp, Nicotiana tabacum
ttctgtatactttgctaatttggttcctagagctgtgctaatcatgaatggtatttgcagaaatttggagaagattatcctaggaaaagaaaagctgttattccatttttatattaagttttttaagaagtgattgtgatcatgccaatgttaatggtttctattaatgttattgttatttatggactgtatttggcttaccttgatattagattttgagcttctctaaat

SEQ ID NO: 1522 - DNA, 322 bp, Nicotiana tabacum
agagtaacacattgtgaatgatcagcgattttgccagcgagaagtcggcttttagcgacaaatccttcacttttgccagacgaataaaacagaaaccgaggttaatgatcgcgccgccgcccatgatgacaacatagcttggcagagcgacatacagtggatcgacgccaagtgcggcagcggcttcatgcatcggttttgcggcgttcatcgcaaaggacatcccggcagagaaaatgccgcacatcaccgccagcaccagcccttttttgagattgaactcttcggctttaatgcccatcttgcgctctttcaactgccc

SEQ ID NO: 1523 - DNA, 272 bp, Nicotiana tabacum
tcttccaagcccgtggggactgctgttgttggccctggcgggttggccatcgcaaatccgcgcgccacagccatcgctggtgtacctggtgccgagcaactaatcggcatcggaggcaagaagaaaatctcgctgcaggatgttaactctacgtcactgctcaaatctaaaaacataaatttcgatgaaaagtcagggcgaaacgcagcggggaacgacgccggacgacaaccgcaggggcccccgcaagagttcagtatggtcggaaactc

SEQ ID NO: 1524 - DNA, 343 bp, Nicotiana tabacum
ttttcgataaaaagaaaaatcatgatttaatcacttttgacaccagagaatgggatagaaatgattaacacattggatttagaccttatgtctaaaaagaaaaaggaaccagaggagggggaaataatcaaatataaaagcaaaatatacaaactgattatgaaataaaaaataagtgcattgttacatcaataacaatttttaaacatgggaggggctccagaatcttcttcacgcacgttgacggtggacgaagagaatcaaagatggacagaacaacgaaactttgggatcttagatcatattcaatcatcaaacgtttttcgtttattttgcccacttc

SEQ ID NO: 1525 - DNA, 361 bp, Nicotiana tabacum
ttttcacctaataaaattatttaatcatggtaaattaatacaatttagtataaacacacgatacgaataactttttacgaccaaccattgttatctaatggagtcttacccttttcccatcgtaatgtctaataagcatacatcaatttcaattactgatcttatgtcatatagataaaataatacaacatatcaacaagttctaattataccaagcacttaagagcctcccaacttcaaaagaaagataagcatcaaggcaagcataacatatctgcttagggctaagccaacgctgatcccaagcactcatagtcacactcttgggcttcacaatctctattcccactatttccttcgc

SEQ ID NO: 1526 - DNA, 314 bp, Nicotiana tabacum
ttttcattaaaaatacaaactagagttccattttaaaaaatattctatgttcgatttacatttcgaggtatagtcaatgtataagataccaaaaatttcaactaaaaaatgaaacaaaagaacaaacaattagtaaaaatgcaaaattattcaacgaggtcctaaagaaacagtaaagtcagtaagcggagaaaacttcttagcccaagtctgtgactccaaatacatctgcgaaattcgacccgcaacccgacccatatccggtctgttattcgggttagtctccacacaatccaatccgagatgcaccaatt

SEQ ID NO: 1527 - DNA, 289 bp, Nicotiana tabacum
ttcgggggggggcggcggcggttatggaggtggccgtcgtgaaggtggttacggtggtggctctgaaggaaactggaggagttagattttccgttgcctttagatttatttttttggtttgaaatttatggttctaagtttggttgaagttccgttatggtttactgtggttcctgctactgtcctcgtttttgaccgtgagattgttaccgtgatgttacgttgtggatctgtatttacaaagttctctggaatgaagtgaatgaagatttaccgtttacaattaaaa

SEQ ID NO: 1528 - DNA, 225 bp, Nicotiana tabacum
ttttactttgagaaccacatcttaaccattacacttgcaaaattcaatgttatcgtaccaatacacatgtaagaactacaagatatggtgagctactgaaaagctatcaatacattgcagtaagagacatcacattaacatagcatgaacggccctgcagttgcttcagtgtttgttctggcaccaaatgcacaagaaaaacatcaggacaggtaactacgagtt

SEQ ID NO: 1529 - DNA, 302 bp, Nicotiana tabacum
tttgaagtccataaaatgcttctttataaaaatgccaagttggaatacatactttgaaaactttaagcacatcaatcttttcaatgggcattaagatagaaggttccccaaaatttaacttgctctaacacttgaactatcaaaatcaagctaccactaatagcctctcaactctcaagtgactgtctcaaaggcttcaagcagaaactgctgccttcttccttggagctgcttcagtaccttctctaaaattggtcttgaacctgcgagggacgttacgaagatacctcatgcggccagtt

SEQ ID NO: 1530 - DNA, 275 bp, Nicotiana tabacum
ggcattcgtgactatacttctcatattaatccttacatctgatcttaatgactttggatttggaaatcatctatttgtcgaaaatccaaaattcgaagacccacccatctttgatgaaatcaaggatggttcgaggtttctgtacatataattcaagaagatgtggggagagtacctatgtacatagttggggttctctccttatttgttcttattagctgtgatgatgtgatatgcatctgttcataaataaagatttttttttaccttaaaaa

SEQ ID NO: 1531 - DNA, 363 bp, Nicotiana tabacum
ttttagatgcaaaagaaagatttaatttgtagacttcatttaattcattccataagaactctgtaaacagaaaaacacagtaaagtaacgagccaataacggtcaaaaaagacagtcacacttaacattaagatatacccaacttaaaatgcgatcaaaataactaaaatccacatcttctcaattatctaattcctccagtttccatcagagtcaccaccaccccttgagtagcgtgatccgccatcaccaccgtatccacggtcaccaccgccatatccacggtcacggccaccaccataaccgccgccgccgtaaccaccaccgccgccctcgcgtcttccacctccatatcctccacct

SEQ ID NO: 1532 - DNA, 176 bp, Nicotiana tabacum
ttttgatttaatttgtagacttcatttaattcattccataagaactctgtaaacagaaaaacacagtaaagtaacgagccaataacggtccaaaaaggacagtcacacttaacattaagatatacccaacttaaaatgcgatcaaaataactaaaatccacatcttctcaattatc

SEQ ID NO: 1533 - DNA, 224 bp, Nicotiana tabacum
ttttaatttgtagacttcatttaattcattccataagaactctgtaaacagaaaaacacagtaaagtaacgagccaataacggtcaaaaaagacagtcacacttaacattaagatatacccaacttaaaatgcgatcaaaataactaaaatccacatcttctcaattatctaattcctccagtttccatcagagtcaccaccaccccttgagtagcgtgatccg

SEQ ID NO: 1534 - DNA, 333 bp, Nicotiana tabacum
ttttaatttgtagacttcatttaattcattccataagaactctgtaaacagaaaaacacagtaaagtaacgagccaataacggtcaaaaaagacagtcacacttaacattaagatatacccaacttaaaatgcgatcaaaataactaaaatccacatcttctcaattatctaattcctccagtttccatcagagtcaccaccaccccttgagtagcgtgatccgccatcaccaccgtatccacggtcaccaccgccatatccacggtcacggccaccaccataaccgccgccgccgtaaccacccccgccgcccccccccaaaaagggcgaat

SEQ ID NO: 1535 - DNA, 412 bp, Nicotiana tabacum
ttttagaccaaaagcaaacagcattaaacttaataggctgattatttttccagatcatacagttcaaacaccataaatacaagatattttctagctaggctgagcactgagtcattacatcgaacaagagggcggggcgggggcggatgaaagagcttcgaccccaaactccgatccgtgtaacttttgcatgccatttcttaggtaagcagcttcttatgttttccaggttttcaaagaatttacaaggttactaagctatgacagctcactctatggatgacaggtcatttagccttcatcctctgatttagagtcataatctgagttgtcctcaagctttacctccacttcgaccacctgcactgggactgggaatgtgggtgcacttcctccagtaaaacaggaagaa

SEQ ID NO: 1536 - DNA, 284 bp, Nicotiana tabacum
ttttaatttgtagacttcatttaattcattccataagaactctgtaaacagaaaaacacagtaaagtaacgagccaataacggtcaaaaaagacagtcacacttaacattaagatatacccaacttaaaatgcgatcaaaataactaaaatccacatcttctcaattatctaattcctccagtttccatcagagtcaccaccaccccttgagtagcgtgatccgccatcaccaccgtatccacggtcaccaccgccatatccacggtcacggccaccaccataa

SEQ ID NO: 1537 - DNA, 403 bp, Nicotiana tabacum
cggacagatggcaggagcaataccacaagcggtgactgttacacctgaagagcgtgaggctattgaacgtcttgaagctatggggtttgatcgagctttagtattggaagtatactttgcgtgcaacaaaaatgaggagctggctgcaaactatctattagatcacatgcatgagtttgacgaatgacatggattgaactgggtgctatttgacctgttatagtttccattatacgttgtttttcttctcttcattttaaatgtgtgtgacttccttcctatatatcttgccgtgtggagtacattttatttcctcattcccagtggcaaatcttggatactcggacccttttgtataatggatattatatcagtaaaatcgtgccctaaagttagactaaaa

SEQ ID NO: 1538 - DNA, 271 bp, Nicotiana tabacum
ttttgatcacagcaatacagttcattgataatgttaagtacaattcataataatgttacaacagtgccaagattgacaaagtacttctgaagaaatacattaaagataagaaaagcacttccactgataataagatagtggaacaattgcagacaacgtaagaggtgaagaatgttaaacttaaaatgttattgttccccagtcttcagaaacttgcattctatttagtgtttagttgaataattagcattcacattgcggcatcaaggaa

SEQ ID NO: 1539 - DNA, 405 bp, Nicotiana tabacum
ttttagtctaactttagggcacgattttactgatataatatccattatacaaaagggtccgagtatccaagatttgccactgggaatgaggaaataaaatgtactccacacggcaagatatataggaaggaagtcacacacatttaaaatgaagagaagaaaaacaacgtataatggaaactataacaggtcaaatagcacccagttcaatccatgtcattcgtcaaactcatgcatgtgatctaatagatagtttgcagccagctcctcatttttgttgcacgcaaagtatacttccaatactaaagctcgatcaaaccccatagctttaagacgttcaatagcctcacgctcttcaggtgtaacagtcaccgcttgtggtattgctcctgccatctgcccgag

SEQ ID NO: 1540 - DNA, 304 bp, Nicotiana tabacum
ttttacttacaatagttctgataactttaactagtttctaaagggaataaagaaaaagattaatagatgaggcaagggggaatagaagaaaaaaagcaaggataaaaatgaaacacacatatatatgcagagaatatgtaaagatcaaagagcacaagttggaggattcacaagggattgtgacatacagcaactgacattacttcaactccagcacttggaagtaatggaactagaagctttctgctgggaatccgccgatgctcccaattccattgatggcacgttttggcctccactcagt

SEQ ID NO: 1541 - DNA, 396 bp, Nicotiana tabacum
tttagcagaatccatctcttttatgcttatacattataaacacaccacatacagacatgtcttaagttttacacaactcagcagaattttaataagtgaaataagttcagagagctttgagaaactggatataaatcaaaccaagttggaaacggctggactctaaagcattatacttgtgcttagcggcccatggtctggtcacccgggggaatcataacgaccacttgttgggcgttaaacccgggatgagggagcctacgacgaagctcacggccttcctggcaaagagcacaagggtggcagaagaaatgagttgcaaagtcacaagctgactcacattgctcgcgctgcacctcatcctcaacaagctcccacagcagccgcaagatctgt

SEQ ID NO: 1542 - DNA, 450 bp, Nicotiana tabacum
agggttcttctcatttttccattttttcaaagaagctaaggtttacaaagaaactctccttctgttttcattttcaattttcagatttttagacatagtttaatttcgaaaaaaatacaaaaaaaatagaaagaaaatcagtattctttcttttcctttgcttcgatcactgcataaaagaaaaaactcaaaaacatatgttccgtctcttcttttccaatttcgatttttggttgcaaaaaatggagatggtttccattttgcttgactgaagtttggttgtgtgttcgtcgcaaaattgagtcgaggtgtcgattcgagtttttggggttcatttgcggtcgaattctggttcgtgattcttgctgctgctgttttgcttgttcatttcaaaacttcatcggaaagtcagtttgtaatcacatacaaacaaattcaatcgaaagcttt

SEQ ID NO: 1543 - DNA, 391 bp, Nicotiana tabacum
tggaggtggtaggggctacaatagtggtgatttcaatggaagaagcgagttcaacaagggtggcaatcgtggaggatcatccaaccgtgggggtgatggatatcagcgaactgacaacatgggaggtaacagtgggcggatgaatcatggtggtgggatgcctaatggagctgcgaaaaatatgccaccacgggtttctgctacagcttgaaaagtagtagcttcaggcaaatatgtcagctgaatttagtaaatttttcattttgattcataattaaatggttggatgtcgcataggaagaagttgtcatgagctgtgatatttcataagagctcgttccgcaaattttccttaccctattttttcccgttaattggtataggtaggaat

SEQ ID NO: 1544 - DNA, 468 bp, Nicotiana tabacum
ttttgggcagaataaatattgcctcacaattttgacataaaatttatcacatccccaatggaacgacaaaggaggccggtttattcagagtcgtataagttaaaaattaaaaatggaaaaattaaagaaacaagaacaaaatttctctcacctcctgaagtctcactcctaaagttacatgtgaacaacacattaaagctaactcaaactgtctgtgatctatttccttagacagcaattgtcttgtttgtttaattggtggaagtttagcctgaaaaagccccatccgaattggcaattgccaccagttaactgttgcattcaccgtttgccagcagctttcttagcagggatagcagaatcctcatcatctgactcgacatctccatactcccacattgcaagtcttttctgtcgtgcttctgtttgatacttctccaattcatctagagcctgttgtttgtcctt

SEQ ID NO: 1545 - DNA, 308 bp, Nicotiana tabacum
gcaccgttgctctcattttctgttcactcgtgcagcgggatgcattcctgtggaagtatttatgccaaatgatcaaatggcctgtacttcccatttttcacagggagaaggtccatataaaaagaaagtcatattgataaggtatttcagtccatataaagaggaagtcatattgataatgtatttcagtccatatagagaggaagtcatatggataatgtagttcatgtgcaatatattttaagaccatttctctatagttggctacttcagaacctatcaaaaggagaaaaggctatttcagaagg

SEQ ID NO: 1546 - DNA, 385 bp, Nicotiana tabacum
  modified_base (295)..(295): a, c, g or t
ctcggattagaaggcgaactagacactgatacttcaggtatatgactggatgcataaacgtgcgctagctgatcgatagtcggctgtgcgcgatatagattactgatatattagactggtaaccttatgccgaagctgaatttggctgatggtggaaacttatattcccgtgttgtgtttatttctttggtttcttctgaacttttagagggtacttgtgtgaaagtaaatggtttcagcttctttgaagacaaaagtacaacattttgtacgtgtgttaagaaatcttctaaantatgtacaaatactaaatttcggaaaaagtaactcaattggttaagtgggttcatatggcattctaaaccatgaagtttaaattccaaaa

SEQ ID NO: 1547 - DNA, 420 bp, Nicotiana tabacum
  modified_base (406)..(406): a, c, g or t
acccgctccattacttgggtccacgcctggactgtggctgatggggtaattacccaggttcgggagtacttcaacacctcgcttaatgtgacccgttttgggaagaaaacccaatcggattttgaatctataacgcccctgcattgcccctctgtttgggagagtagcctcgctaatcgggtcgggaaatccgttccgggtctagtcctggctctctagataaaagtgcagtttgtgcttggttctagtatgggctgaagttcttttgctgtttggtttggctttctattttggttttaattttgtttaagtttatttgttgttgtggtcgagttaaccaatgatgattgggagtgggagacccttctacttggtctgtttggtttgcaataaaagtgattttctntggttggttaaaaa

SEQ ID NO: 1548 - DNA, 284 bp, Nicotiana tabacum
gaataaaatcgaccgattgtggcaggctataagctgaccaatctgcgaggaggaagactacgagcacttttttgcgaaccgtggtgtcaacctcgaagattgggcaacttttcggccgaagttcctaggcgctatctcctcttgtataaaaaacaaacaaaaaaaagtcattcctttgtattatacttcaatgcgttagtgttataagtttttgtaattaaattatttaatttttataaaaaaaataaaaaaatattaaataaaagttgaataaaaccccaaaa

SEQ ID NO: 1549 - DNA, 390 bp, Nicotiana tabacum
cccatgtactgtgataaaaaccaatgaatattgttgtacaaatgggcctggatcatgtgggcctactgatttgtcgagattttttaaggaaagatgccctgatgcttatagttatccacaggatgatccaaccagtttgtttacgtgtccttctggtactaattacagggttgtcttctgcccttgaaattgaagcctgcaaaattatgactatgtaatttgtagtttcaaatatataagctacacaagtagtactaagcactattaaataaaaaagagagtgacaaagaggagaggctgtgggtcagattctcttgttcgctgttgtcgttgttgtagcattctggttttaagaaataaagaagatatatatctgctaaattattaaaa

SEQ ID NO: 1550 - DNA, 358 bp, Nicotiana tabacum
agaagcttaactttcaattttctgatgacaagaaaatgaagcaagtggttcagcggacaacagaattgaatgaaacaatttgtggagtaagtggagttccaataaccaagaaacgcataacagacgttgaggggttattattacgctccttagagcatattcaagactgtttatcagtctcatgaatcatgttaacatctcaatattcgatcccagtatctaaacataggaatacaatatacagatgtatatattctggacttaattcccagattattccatgagtaatttgtagtaaagtcatatgttttgtaactgtggagtttgattcagataatagacaactatttcaataaaa

SEQ ID NO: 1551 - DNA, 230 bp, Nicotiana tabacum
gttgtatttggaatgagttgtgtgtagttcctgtagctgtgcaatgtagaattttagatgagggtgtacttgtttaatgcttgttgtttcaagattcatagcagataggatggttaagctatagccagcacagaatggtgttagaatgaagctgaaaatttgtgggctttgttgatggtgatgactctatcttatgactgttttaagtctgaagtttttcttggttaaaa

SEQ ID NO: 1552 - DNA, 521 bp, Nicotiana tabacum
  modified_base (74)..(74): a, c, g or t
tccaacgcgttgggagctctcccatatggtcgtacctgcaggcggccgcgtaattcactagtgatttaatacgnactcactatagggaacaaaagctggagctccaccgcggtggcggctgctctagaactagtggatcccccgggctgcaggaattcggcacgatgggtttcctttctttttattcttcaaagactatggtgaagtttgctcacgtcgttgctttcttgcttcttgcttcactctttcaacccctcactgctcgagatttggaaatcaatgtcttgcaacttgatgtgtctcagtctggttgccctggagtgacaaaggaaagatggccagaacttcttggaacaccagcaaagtttgctatgcaaataattcagaaggaaaatccaaaactaactaatgttcaaacagtacttaatggtactcctgtgacagaagatttaagatgtaatcgagttcgtcttttcgttaatgtattggactttgttgtacaaactccccaggttggctaa

SEQ ID NO: 1553 - DNA, 377 bp, Nicotiana tabacum
ttttggaatttaaacttcatggcttagaatgccatatgaacccacttaaccaattgagttactttttccgaaatttagtatttgtacatatttagaagatttcttaacacacgtacaaaatgttgtacttttgtcttcaaagaagctgaaaccatttactttcacacaagtaccctctaaaagttcagaagaaaccaaagaaataaacacaacacgggaatataagtttccaccatcagccaaattcagcttcggcataaggttaccagtctaatatatcagtaatctatatcgcgcacagccgactatcgatcagctagcgcacgtttatgcatccagtcatatacctgaagtatcagtgtctagttcgccttcta

SEQ ID NO: 1554 - DNA, 297 bp, Nicotiana tabacum
gttgacactgagaaaggtggccttgctataaacccgagatttttcgttgattttggagcagaacctgatggtccatccttggctcatgaaatgaggtatcctggtggtgactgcacttctgatatttggatataaagtggctaaaaaactgatcaagaataaagtctggtgactctggtcccatgttgttagtttgcctactgaatatccaaatgtattctattagtgaaacaaatgtctgtactgtaccttaaaacaacacttcaataattttagcttgcacttgtccttttaaaa

SEQ ID NO: 1555 - DNA, 279 bp, Nicotiana tabacum
tttaaccaaaaagaatttgctaccatcttaggtatatgtgttgattcttcaatcaatccatataaatcacacatatcgaagctgctatataagtttgcagtataaaatttaacttcagacaactgatttaatggtaaaaaatgcatcaaaaccaggaacacataaccggtcaagcccctactctttttaacacttgacctccttgagtccatgtgcgaggtacaaaaaggtaggatcagtggcgccatccttgtagtaggcaaacaccattccagtatc

SEQ ID NO: 1556 - DNA, 355 bp, Nicotiana tabacum
ttttgctcactcctaaaacaccacaatatataagatataaaaactacaagatggctaatctctttttctccatttaactgggcaaaagtgcaaatatttgatttcaccgacaaaattgtaaataatgtctcacgcagacaacaatatcagataagaagaaactacaaactaaagattcaattaagattccagctcctcaatcttcctcctcagcctcattctcagcaatgttgaagtacctcagctcatagacattgcgatccttgtttgcagaaataactctgagccaatcacggacattgttcttcttgagatacttcttggtcaggtagttcagataccgcttggagaaagt

SEQ ID NO: 1557 - DNA, 346 bp, Nicotiana tabacum
ttttgtagccaaaatctgcaaaaacatgcacttcaaaaatagtaacttcaaatggagcaaagtgttgataattattggtgttaggaaaaataaatacgtcagaaaattgggagatgacgggagatcaaaagggattccgccattgaagcctccaaatcagctacaactgaacaaaaagcagaagggaaatgcaaccttatcatttcttctttccatctatgtttgagctctattcatatgttgagaagttccgtccctatttaatttctgcagaatccagatgtgaggccggcgccaaactctgtagcagcattcacccccatctgagtatagcagaaccccacgt

SEQ ID NO: 1558 - DNA, 348 bp, Nicotiana tabacum
cttacgtggggttctgctatactcagatgggggtgaatgctgctacagagtttggcgccggcctcacatctggattctgcagaaattaaatagggacggaacttctcaacatatgaatagagctcaaacatagatggaaagaagaaatgataaggttgcatttcccttctgctttttgttcagttgtagctgatttggaggcttcaatggcggaatcccttttgatctcccgtcatctctcaattttctgacgtatttatttttcctaacaccaataattatcaacattttgctccatttgaagttactatttttgaagtgcatgtttttgcagattttggctacaaa

SEQ ID NO: 1559 - DNA, 408 bp, Nicotiana tabacum
ctactgggctaaccctgttgcatggaccttgtatggtttggttgcatcacaattcggagacatccaaacgacactatctgataatgaaactgtggaacaattcttgagacgttactttgggtttaagcatgattttcttggagttgttgcagctgtgctcactgcatatgtctttgtgtttgcctttacatttgcttttgccatcaaggcgttcaatttccagagaagataagtgaatttaatcgactgaagagctttgaggaagcagtggttacaaaattagtatgtataggttactatttgagaaagtcttttcttttcaacttctgaatactaggtgtatgttcttgtaatattcattggaaatccaaactttatttattaacatatcagcagttttgttccaaa

SEQ ID NO: 1560 - DNA, 437 bp, Nicotiana tabacum
tttacgtctaacatgagctgtagttgacagttctcattattcataatggtagaattgtgtgttgctatttctacagcaaatgacttcatctaacataaatcttatgatttcaggaataagtgcgatggggactcaagtccaaatttcttggtaggtgtaaaaaaacttatgatctggctttttccacgtcttcctccgagatctttgacgacattaccttctttggttgacgagccatgtcataagttgcatggaggccaaaaagaatataatacatcagcattacagccgtacatatgccaaaccttataaatgcctgagctcctaatgatcccatgagaaacaagtttattgcaattgagagggatgggaaccatggaaccagtgggactccccaaacttttggtgttctttcctgtggcaaaagaactgatatt

SEQ ID NO: 1561 - DNA, 374 bp, Nicotiana tabacum
ttttccagataaatacacaacaagactgcagtataattctgttaaaatccaataggcaactatcaagatcaactgaagcgaacagaatgtgaaaaatatgaagttggtgcagaagtaaactggaaatgataaagttcctccgtgatagaatgactattgaaccaaagaaaaattcaccaatctttaccaagatactttaacctaacagaactgaaagaacagatacgacatagtacaattgtccggtatgctaaccattgccaaccgacatgcaattgcactaaataacaggggattatttctgattaatatgcatcttaatagactccaaaacgcttagtcaaaatggccaacatgttacattgtctatttta

SEQ ID NO: 1562 - DNA, 279 bp, Nicotiana tabacum
ttttgttgtgaattgtagattaaaaaaaacatggaactacaccattattggagaccaaataaaaattcatagataatctccagtacatacaatagctagctttacagggttatcaaacaatcagatactagaagagactcctcattgagtcattattggagattaaaatgaaccaactttgaaaaataaaaggggcgatcttcacatgtcaatccactaggaaattattccatccaagaattaacatacttcaccatcactactgtttcaaagaatcaa

SEQ ID NO: 1563 - DNA, 316 bp, Nicotiana tabacum
tgaatgctgctacagagtttggcgccggcctcacatctggattctgcagaaattaaatagggacggaacttctcaacatatgaatagagctcaaacatagatggaaagaagaaatgataaggttgcatttcccttctgctttttgttcagttgtagctgatttggaggcttcaatggcggaatcccttttgatctcccgtcatctctcaattttctgatgtatttatttttcctaacaccaataattatcaacattttgctccatttgaagttactatttttgaagtgcatgtttttgcagattttggctacaaaa

SEQ ID NO: 1564 - DNA, 346 bp, Nicotiana tabacum
ttttgtcaaaaatatcaagtaaattaaagtcactaagcagttatcttagttacacccgaaacatgattccaacaagcaataaaagaaaaacaaactcaaaaaacctatgacaatagattctggtactatggcttcaaaaaaaactgaagaaaaggatcttaaggaaagtcaggggaagcttaatgtcctggaagtgccagaaatacctctcaagccgctgtctgtcatctcagattctcgatgaagctactcatttctgagaacattccaaaaccaaactccatagttcattgatgctgtagttaaaacgtaagcgaaattcagcttagttagttttcttttcgtc

SEQ ID NO: 1565 - DNA, 391 bp, Nicotiana tabacum
ttttaatccgtgtaaacattaatctcgggcaatattcattatcaacactagatccaaaaacaaaacaatcatgtaatccataataaactagcatgtggatctataaatagctgaaaagtctacaatttaaccaaggaaaatatctgcgtaaggctgtgtttcaatttacgcttatttcgtttcatggcagcgaggactacaaattcaagcatacactgtccaaatagatcctatttggaataaaaagggtagctccaaatctcgcaacaatatgctgaaaactcagatctctatttcagtttgtgaaagctcaaggcatgtcaattacctaacaaatgatctcactccacagagatggagtccaacaatcttttaccttcttcgctcagct

SEQ ID NO: 1566 - DNA, 471 bp, Nicotiana tabacum
ttttcaaatgaaatgctcattctttattgctcaaaaaatgtacagatgataataacttgaaagagaatattgggtcttataacttaaaaacaaatccaatccttctccttattaaaagtagcttatttgctatgctgcttctagtgctcaacaacaacaattttactaggtatagaatgaaagaattacatactatattaccagtacaaaatttacaaacttgagaggcatctttgcccatttaagacatggtacagtagtacagcgttgcgtcaactggacctcgacgatgtagcctccatgtatgtagttgtgtacagaaccagctcggaaaacatgtacaatgagcaagttcccaacttttgaacagtggttatctgtggctactgctcctttctttcctatcttccaaaggattcgttctcgccaatgaacgagcagtgaaacctacgcattggtgaggcccatcga

SEQ ID NO: 1567 - DNA, 312 bp, Nicotiana tabacum
ttttaaacaggaaagacgatgcacatattcaaagatcaaagtaccagcgtttacaccagattataaattgacaaggctacattcagtattaaatttgctcacacgatgcaaattaagcaaactccaagggttaaacactaacagctaaagggatcatcatcaaaagtttcctgatcagtgcaggtaaggagcctggtaatggtagccatttccaaagaagtcatagccaggagaaaagttgtaaacagcagcacccatgaataaaggaacatgggtgctggtcggtccagggtgagcatatggtctgtcata

SEQ ID NO: 1568 - DNA, 427 bp, Nicotiana tabacum
ttttaataccaagccattagtttctcattatgaaaaactttacaaagacaaaattacacagaactacaagccaaaaaagctcaacatagtaactttgatcaaatgatcatataatatttgcagccttggacacacctcagcaacagaatggaacatcaacaacactaagaagttgcacacctaaatccaaaacaaaaagactcgactccgtagcagaaagtagggtttacatgaaaatgtatgatggttagcaacactgaaactgtctaacaagtagaattcacactctcaagacaagcatatctctgtcgttagccgtttggttttatgcaaaaaaaataaatggagcagtacattatcatacaaaccgccttctgaagtttcgcgtagttgtctggtaggtgcggactaacagaccaactcctat

SEQ ID NO: 1569 - DNA, 332 bp, Nicotiana tabacum
ttttatgccaaagatccaaatgacccattgtataaaatttaccaaaaaatgtactactttcacctttttaaggaccttcaactacactgagtataactcccaagcaagtcatatgagcaaactatgaaccaagaaaatggctaaatttgcaaatccctaaaaggtgtcatgaaatgcaaattttgctgaaaactaactatgtttccttcaactgacctttttttggataacctctgaattctatgaaagtttctatacaaaagctgtatgactaacaatggagtaatgacttcagtagaggattgatgtaccggcgatttaggcggtagctg

SEQ ID NO: 1570 - DNA, 441 bp, Nicotiana tabacum
tttttagatacaagctttcatcattactgtccaactgccaaatggctttctaatttacataatcagagaaaaagaaaagcaaagaaaggaagatagatacctaaaagaattcctaagatgaaaactaaaagcaaagtcaagatagtgagagctaaattgttttttctttttcttttctgggcattcaacctattctcttatcttcttgcttcgcttctgtaagacatgaagataagatttatatactggcagtggaatgcaaccatctgctgcaaatggtatgataaacaggcatcatctgtttggagcaaaagaaagagccaactccacatcatggaaattgcatctatcctaatccggcactttgctgaaaagggctaaaaccatgtagttgtctaattccaatatttgaagtttatcatccactgcaacaatcacaaa

SEQ ID NO: 1571 - DNA, 250 bp, Nicotiana tabacum
actactcacatcatgccattttgatgtggggctgattttttattgttgataactttggggggttctttggaggttttgtaaatcataagcaattttgttgagaaaaaaaaaaatatagaattgaaaaaagaagaaacttcaattgttttcaagtttcaactctagactagctagtgtttcttagttcttgatttgatacctctttccctgcaaaatcatttttatagattactactttgatcacacaaaa

SEQ ID NO: 1572 - DNA, 469 bp, Nicotiana tabacum
gtgggtgacagatatgaagctggagggccagcccgagaaggaagaagctacagagatagagcaggaccctatgaccgccctcaaaggggaggacgcccaccttcctttgaccgttattgaagtgccatctatgtagaagatgttgagttttagttggtctctgccgcagtttggtggtatggagtacagtagggtaactgtatgccgtcttgtttggaagcagctagtagttactatgcatgaatactgacgagtagagtaaattagtagaaaacgtcgcagcgttatgtttattttagtgaaacagattggacgtctttagtgtcttttggttttgtttttatgcttttgtagaagagggagccttcctctattggaacgcattatggtaccctgtgtgccatttccacttattgctcaaatcatactctctcatcgtgaataacaaggttgtcctttgtaatcaaaa

SEQ ID NO: 1573 - DNA, 451 bp, Nicotiana tabacum
ttttgagaaaccgaaacatataccgaatttatttcagtatgttagtataacatttttaaaaacgaaaatacagaaaccgaaatctttcaaaaccgtaccaaactgaccgatgaacaccaccaccaccccgccaaatttctcctctaggctgcagcaaagtttagagttgacataaccaaactataaacgaccagaattagagctccccaaaatgctctttcttaagtgaaaaggaaaaggggaccaggtgaagggagaaacatagaaacagtatctggcacctcacgtccggcatgtattggatcataccaaaaaaacagtgccagttcagtcagacagatatgccataattgcttatcttcgtaacttccttggtgagaacattcctttccttttttgcctctgaagcaaggttggaaacttgtgaccggaatcgtgaaacttctcttcg

SEQ ID NO: 1574 - DNA, 295 bp, Nicotiana tabacum
gcggtagggtgaggaagaatggcgttgaaaagtcagcagaagaacttgataaagagctggaaaagtatcatgctaccgcagatgctatgcagacctaatgacggtgtgtactttcaggccttgtggcataagcaaaagaattggaagaacatttgttgtaaagagtttcccgaatgttttagtgatttttctgatatctgatagatttggaggttactggttttggtttaatggtttgtaacatgactattggaatgtcaatgctgtagtatatgactatatagttgcgttaaaa

SEQ ID NO: 1575 - DNA, 310 bp, Nicotiana tabacum
tggaggcggtcattatggaggcaagtttaagcatggcaagcatgggaaattcaagcacggaaagcatggcaagtttaagcatggcaagggcgggatgttcggaggcaaattcaagaagtggaagtaaactagtgtctacttataatatcaacttcacctggctttttacattgtgtgctaatactgcgtctctttaaataagacatagacatactacatgttataattgacctataggcctgtgagatgttctcttgtaatattacattttcaatgctaaattgtgtgagagtctgcagttggattaaaa

SEQ ID NO: 1576 - DNA, 266 bp, Nicotiana tabacum
gatatgcctggtggtgcacagagagtccaatgtgcacagcagtaattgggtatgcttcaagaaattaacagggcctactctcccctggtaaaaaccatgacattgtcaggaatgttgctatctgtggtaggaggtagattactagtaaaggagttgggaatctttattatgcaaactaacactataagcagaatcttactgcttgacaattgcaagtgtgcttacatgttattcgcaatttgttagttattttattcaatcgaaaa

SEQ ID NO: 1577 - DNA, 321 bp, Nicotiana tabacum
atggatattatggtggtggttataaacgtagaggatgccgctatggttgctgcaggaaaggttacaaaggatgcaaaaggtgttgtgcctacgcaggtgaggccatggataaagtcactgaagctcagcctcacaactgatcattatgtgtaatatataaagagtgtaagttatatatgccgttagcgtatataacttatacattgtgctactttagaccttgcttgtaacaagtatgaataaagccattcggttcttagggatggttggtcatgtaatgttttgttgtacaatatattgtgataatatgtttccataaaa

SEQ ID NO: 1578 - DNA, 355 bp, Nicotiana tabacum
  modified_base (325)..(325): a, c, g or t
gacgtcgatggagacgacggtgatcaggacggagaagacggcgccgttgaaatgtggtttgagaattgggaaaatttattgaaaatgagaaatggggaaatgggttggtatagatgccaggacatgaaagtaattgacggcaacgtagttaggttgtgggacggttgtagacggcggaggaaggcggaaaccaccgctttctcagttggcgtaggtagtacttggtagatttatagaaaagaatcaatggtagtaggttactatagcctataggtgtatttagttgggaattgcaatatatgaaaactaaagttgtacatttgtnctagtcaaaatgttcgtaatacttcaaaaa

SEQ ID NO: 1579 - DNA, 253 bp, Nicotiana tabacum
gagcgtgaaggggaagacactggagcagaggataaaggagaaggagataaagaaggcgtacaaggagaggatgaatgagctcaaggaagagataaggcagaacaaggttgacagaggaagaagagggaggaaagagacagaggaagcaggaaaacattctcagtccgggacaaggttcagaagatcaccaatccaaagacgcttaaaaagattgcaaatctaagcaaaggaaacactcaggttgtttctgacg

SEQ ID NO: 1580 - DNA, 388 bp, Nicotiana tabacum
ggaatgtcgtttggtttagttaacacagggcatcctttagcccagttgctctattgctttgactggaaactccctgacaaggttaatgcaaatgattttcgcactactgaaacaagtagagtttttgcagcaagcaaagatgacctctacttgattcccacaaatcacagggagcaagaatagcttaatttaatggagttcttggaagaattaaagaagaagggctatataggtgagattttttgtatggttgcaaggtttttagttcatacaataagacaatacattatattccagtattgtgtatcatgtataataaggttccttttgtttattattagacacaataattaatctaattttgaccaatcaaaaaaaaaaaaaaaaa

SEQ ID NO: 1581 - DNA, 366 bp, Nicotiana tabacum
tgggatgtacccagacttggagaaatccactagctttactatcattcagggtgttgctcccatgaagagctttgaggaattcggagagaaagcagcagaaggaggaaatgggtgcaagtgtggatcaaactgcacctgtgacccttgcaactgttaagaatattctcactacaaaaactgcattgtgtctctgtattaagtgtgtgttctaaaagttattgtaattataacaataaaactacaaccatggaacagatatgatcagttcttaggtttgtgtgttactcgtgtgacgtggcttttctgtttgttaattgggttgtgtatcaatatactacataagtttgtttgtttgtttgtttaaaa

SEQ ID NO: 1582 - DNA, 302 bp, Nicotiana tabacum
ttttacacataataaaaagaggagatatatattgataagttcgtgttacagcccaaatcagcttcctttcatacaaatatcagattagaaaaccaaacagagaaaccatgaaacaacatcaaacaaaccttgtcaaaaagatttggagatgctcagtttcatggttgtagtcttattaatactacaaagcttttaaacacatatatttttgggtcagctagtgaccatgttcatcagcagttgcaagggtcacatttgcagtttgctccacacttgccagccatttcctccttctgttgcct

SEQ ID NO: 1583 - DNA, 353 bp, Nicotiana tabacum
gaaggaaagggtaatgaacgctgcaccatatggcctcagcaagaaatcgggtgagtgctccacccccgagtctaacggagttggtttctctgcaacttccagtgttggtactagtcctctgatagcaggtaaggagacctagctacgacgtctgaaggcagcctattgccataaaccattgaagcataatctatttttattaagcaagttaaaagctgtagctatcaagttttgctgttttaattgtaatatcaacttggttagctttagccagacttcctagtatccaatttgttttgtcttttgctgtacttaattctctttcatctgaacctgatggaattctcccaaaa

SEQ ID NO: 1584 - DNA, 334 bp, Nicotiana tabacum
ttcaaacctcaagctaaaaaatggttttgctgcatgcaaagcccccatgcagaatcctgacaaggttatctatctgcccgcgtcgaatattgaattcatattcataacaaactccagaactccctttgtgttggcgctggagacagaggaattgctcaagtcactttttgtcttgtaaacttgtgatagtggggagaatatgaaaaacgatatgtttgatgtacctatgtgatgtatttgtattttacatttagcagacaagttttcgattgctttcatatacgtgtggttagcacatctcaactattattattctgataatttcatcacaaaa

SEQ ID NO: 1585 - DNA, 305 bp, Nicotiana tabacum
ttttaggaaaagtagaaatcttattgcatataagcattggtaatttacaattacatttttccctcggcaacccgattataagttacattttttagctactctgaggagactacgcttgagtttcataacaatgaaaagtcctcagttctccaaaattcctaatacaatgcatactaaagatcctattggtgtataacctttttgatgtctcaattcttatactcttatgaataatacataacaattgccacgaaattttctgaaagaataggtggcttaaggcaatatttacaagcctttttacc

SEQ ID NO: 1586 - DNA, 404 bp, Nicotiana tabacum
tatacacaatggcggtttcaagaaagaagtgcctaatttgcaggaggttgttgtaatggagggagctggtcacttcatcaaccaagaaaagcctgacgaaataagttcccacatttatgattttattcagaggttttaatcaacagagtccctctttgtctttcaggttactgcgacttcatcacttggaataagcaatgacacagtatacactgtaatgttaccacttgaatgtatctatgattgatactgcattttacctttctacaaattactggagttcttggcagaatttgaggtgtacttgttgatgtttgtgacaaaacaagatacccaatcagataatgtgcctgaaattgaaaacttgattgatgggaaagatggtatttgcctctctgttaaaa

SEQ ID NO: 1587 - DNA, 368 bp, Nicotiana tabacum
tttttaagtgttagtgtcacaaaaattctataaaaatgaatatagtacatagactacatctactgtgcatatgatgcaggattgctataataatgttacaaacaaaataattaagaatcaaagaatggataggaaatatccataccaacacaggaaagaagtggaaaaagaaacagaacactagcatagtacctattcagatttcctgtccatctttgtcgacaacttcctcttcattctgctaaaaggcccaaccgtccggtccattatatacatgtagataacctggctccaagatttgtaagattctaagttttcgtagtattccggtgcaatctccttcaccttgaagagcttgcttccagaaa

SEQ ID NO: 1588 - DNA, 424 bp, Nicotiana tabacum
ttttaatgataaggccactactcattaacatagaagtaaaaatgatcagaaatgtgcagctgcggaatttgaaagagcggttgtatcagcccccatattacacaattgcacgacgatactggaagtcggactaaccaattttatactattctgacatctgctatgaagataaaatgctgataaaattgctccttttaagactatacacaaagacaagcctactctcgggctccatctcaaaagaataccaaagtttatcaaaaagaaaaaaaaaagaatgtaatcaaaccagacctctgtgtgctctggcgatcgactatattacggctgtcaagccccccctgaaactcttggcaacctcaatcactataatctccggactctgaagagtccgactcttgatcctcattgacatccccatccc

SEQ ID NO: 1589 - DNA, 227 bp, Nicotiana tabacum
gcaacaaggaaaagaaactcggagcagaggagaaggaggaagcttaatactctgttaagatattttcgatacaagttgttttatagccaaatacagctaagtaattcattaagatggcgtaccatgtcgtataagctttcaacacatcattcatttccagagtttgtattataggaccatattgatttctcaaagacatcaatactaatttgccaaatgtattaaaa

SEQ ID NO: 1590 - DNA, 314 bp, Nicotiana tabacum
gggcgacgaatttgacctctggttgggtgaatagctagctagctttgcctggttatcattcataccaacttctttgatttgtcctcgttcatacgccagaagtatcatctgcccatcaacttttacattcttgctaggacttaggagtatcttgtatgagctagcttccccttgttatcctcttgctttgtacttgttttgttaggacatttttgtacaggcaatgacctaacaaaatggagtattaactgctcaatgtacattaattctgtgtacctaatgaacatcaaggagtggaagtgtaacaactaaaa

SEQ ID NO: 1591 - DNA, 291 bp, Nicotiana tabacum
tgggtgaatagctagctagctttgcctggttatcattcataccaacttctttgatttgtcctcgttcatacgccagaagtatcatctgcccatcaacttttacattcttgctaggacttaggagtatcttgtatgagctagcttccccttgttatcctcttactttgtacttgttttgttaggacatttttgtacaggcaatgacctaacaaaatggagtattaactgctcaatgtacattaattctgtgtacctaatgaacatcaaggagtggaagtgtaacaactaaaa

SEQ ID NO: 1592 - DNA, 246 bp, Nicotiana tabacum
cagcaacaaggaaaagaaactcggagcagaggagaaggaggaagcttaatactctgttaagatattttcgatacaagttgttttatagccaaatacagctaagtaattcattaagatggcgtaccatgtcgtataagctttcaacacatcattcatttccagagtttgtattatagggccatattgatttctcaaagacatcaatactaatttgccaaatgtattaagcttccgtttcagttaaaa

SEQ ID NO: 1593 - DNA, 489 bp, Nicotiana tabacum
ttttaaggagaaaaatcctttggaacataggaacaaaaatacagattattcaacattaaatattttgagaaagaaaataaaggacaactgccaaaacctctttcctcattctctttcctcaagtataatgaactattgtgccttactatcacattttgacaagaaaaaatgaaaaataaggaacagtatcttatggtggattctgtaacatgctaagatgtatatatggatgaatgatgcatctgtgaactaatccaacatatctcctcctcccatcactcaaagggtggaatactttgagatcaatttgtcaacatgaattactatatcatctatgcgaggtcggactgtcgcttgtggctgaagcatccatgtcacaaactggtgaagggcgtccggatatgaagtattaggctcagttggccactttatttgtgcatttacaatagccaactgcggacttccatcagattcctcaaatgcatactc

SEQ ID NO: 1594 - DNA, 543 bp, Nicotiana tabacum
gaaaatgataacatcaaagcagttattcttgttctcgttgtgctactggtggttacggtcatgcagtctcttaaagaggagccctcaagagaccacgtagatcatccaagtagttctgcatctccatcagaagcacttcgctctggagacaaagaagacaagatagactaaaattttcactttggtgaacgtcaatcccaatctgaccgagataagttgcttgagaaatctttgaaaagatgagcaatcgacatggcagtcactgagtggttcaaccatgttggtaaccataatcatcgtaagccagtatacgagcaactatagttgtaagattgcttctagcgttttctgcatccagtgataggaaatgaatactcagtgcaaggatttgttgacagtaacggttctgaaaatggagacaaattttgtttcgttctgtgtaaatgagttcaagacgaaaaacaaaaatgctgcgagttctatttcgcagcttgtccactgttataataagaatatttatttagaagctataatagatcaagc

SEQ ID NO: 1595 - DNA, 447 bp, Nicotiana tabacum
ttttcacaaataaaaacttaacaatctttattaattatcaacactagtggaggactatagtcttccttattcctttagtgatacagactataacagtgaaatgatcccaccaatactaactacagatagtagtactagtaattctagagcttatgaaatgtaactttcaaaagttgatcagatctagaaccaataaacaaaacccttttgctaccttcaacaagtattccaatttctccacagaatggtctgcatgtctcacaaactccaggacaatacacaagtttgtaagcatcctcgtacttgtcaatcctaaaccaattgctcaatgtttcacgcccaggatttccttctactccaccaactgtcaccaaataacgctgcggaattaattcagtgttaattctccatactgtagacgaatcagagatatgaatagacgtaaat

SEQ ID NO: 1596 - DNA, 316 bp, Nicotiana tabacum
actagttcttcccacaacagggttacccaccacaggggtaccctcaacaaggttaccctcctcaagggtaccctccccagtatggtgctccaccccctcaacaacaacagcaacaatctggtagcactggcttcatggaaggatgtttggctgcactgtgctgttgctgtctcctagatgcatgcttctgatgatgggttggcggcagaaattgatgcaaccagtatggttttgtgaggcggcctcatctatatggattattaatctagatttttttttctttcttctgttttgtccttgctgtcttgtcctcgat

SEQ ID NO: 1597 - DNA, 246 bp, Nicotiana tabacum
ttttgaagcgcaagagttaacaggtatgcaattgtagactgtaaatctaaattcacttaattccagataacttcgtaaatacagatccacaaaggtaacatcacggtaacaatctcgcggtcaaaaacgaggacagtaacaggaacaacagtaaaccataacggaacttcaacaaaacttagaaccataaatttcaaccaaaagatctgaaggcaacggaaaatttaactcctccagcttccttca

SEQ ID NO: 1598 - DNA, 405 bp, Nicotiana tabacum
cgcgaggatattcttcaggaactcggttgcgactggtgaagtttatccgcttgaatcggaagtgaggatttgtgaggagtgtaagacgggtgatgtggtgactgttgaactaggagagagtaggttgattaatcatacgactgggaaagagtataaattgaagccaattggtgatgctggtcctgtcattgaagctggtggcatttttgcttatgcaagaaaggctggaatgattccttcccgagatgcttagtttttcaaagtggtaattgattcggttcaaatattttcttttaaagttttgtattggtgaaaacaaatgattgcataataaatatggtgtttgttgtatgatttggagaaaaaatcagcacctttaaaaaggtgtcttgtgttctgttaaaa

SEQ ID NO: 1599 - DNA, 455 bp, Nicotiana tabacum
ttttgactaggcaattaatagatgtcaatattgaactaatcaatacatctactccaagtaacagaattatcctcaggtatttattatcaacagatttacagtgaatcaacaccaacaattaagtcatgcatttttttatcaacaacggatctcttccccaactaacttccaagtttggcgcctatccttttaagttgcaggatcatccatcagctaaggccattgaataccataatagcgagacaccgatttagaataaatagctcttcacatgctctttgatttatctacaatcccgtttagactactgtttttacatctagcggtcataaggaaattccatgtcgttctctgttactttgaatggttgaggatgttggccagagcaatagagattccacatcttaaaataagatctctccagattccgtacccagcgtcctgtgtcaaacaga

SEQ ID NO: 1600 - DNA, 374 bp, Nicotiana tabacum
ttttgaggtatcacaatatagtgaggacacttctgtaaagaacagaatacacaagtacaatatctcatattggagatttaacaaaatacacaagtacaatctcttgtattggagatttaacagagtacacaaggatactctcttagtttcatgaccaatttttatttactgtaagttatcctctacctacttaagagcttgatctgagttaacatgcatctaacatccttactgttaggcctctcctttggattatccagggtgcgaaagcaggcaatcttgagaaccaaaagcatttgctcctcatacccattacccatcagctttggatcaattgctctttttggattctcagacgtcctgacatttctcat

SEQ ID NO: 1601 - DNA, 350 bp, Nicotiana tabacum
ttttgagaagtcagttaatttgccacactaaaaaagtacaaacgtcatattcaatagagttcattttcaacacaataagaaaggtaatgtacagagcaaaccatatgctatctagcccaccaagaaggaatagaattgttgatcaatgtgctagcacttgtggttgactctaattttgtaatctcctcaactgctttcataacttcaacagaatctgtttctagcacttgaccacctaaaattatttcatctaaaatggtatgcatcttgctataattgaatactacatcaagttcgcatacacttctgaagcatttgtccagtgtttccaccaaaaacttgtattagat

SEQ ID NO: 1602 - DNA, 247 bp, Nicotiana tabacum
caattgaatattcgctataactaggtctatttacagataacaagtaaaaaaattcacccacccaataagaaaaggaagaaactaaagaaaaatattacatcaattgtctacaaaattcctgaatcccatcttcaagtaaccaaatcaaaagtctcaccattccccgaataattcaaattttggaggcagagatagccgcgatttcttcgccggatgaggactctccacttcatcctcgccgaaacca

SEQ ID NO: 1603 - DNA, 389 bp, Nicotiana tabacum
ttccgcggtggacgtcgtgaaggaggcggcggatacggaggtggaggatatggaggtggaagacgcgagggcggcggtggtggttacggcggcggcggttatggtggtggccgtgaccgtggatatggcggtggtgaccgtggatacggtggtgatggcggatcacgctactcaaggggtggtggtgactctgatggaaactggaggaattagataattgagaagatgtggattttagttattttgatcgcattttaagttgggtatatcttaatgttaagtgtgactgtcttttttgaccgttattggctcgttactttactgtgtttttctgtttacagagttcttatggaatgaattaaatgaagtctacaaattaaatctttaaa

SEQ ID NO: 1604 - DNA, 408 bp, Nicotiana tabacum
gtttttcaaggcaattgaagccagtgctgaggagtacatggaaacttacaaggctgacttggacaagagacgggaggagaagcaacagttagaggaaagacgtagaagggagaatatggaaaatttgagaaaagatatggagaaaaccggaggacaaactgtagtactgagcactggtttgaaggatggagaagataaggggaaggctatgatggacgccgaggatgaagaggaagaagaagatgatgacatccagatttttagtgaggatgacgatggtgacatagacgaggacgaagatgaagaagttgctggctttccattttaagattgtacatggtgtcttttgagaaacacaaccctgtataggactgatcaaagtgctaaacccaaaattgagggacacaa

SEQ ID NO: 1605 - DNA, 391 bp, Nicotiana tabacum
ttttgaccaacaacacaagtcaatatctttcaacccaagaagccatgtacacagtatatgtattacatcataaaccaaatgtaatagcagacaaaatgggacaagaccttcaaatctaaacagttataacaaacatgccaactggctccaagaaaaacttgaagtatcatcacttgcttatgcattatcatccggtgtcttcggttcctctcttggtttcaaagacgccgaaggcgatggagcaccatcttgacccatttcagctctcaaatcgttgatgctttgttcaagttcatcgattcggtttcccatctcgtcaattttcgagatgattgattcagacattgtctgaaatctggtttgcatttgctgaagaagattctggacaaac

SEQ ID NO: 1606 - DNA, 421 bp, Nicotiana tabacum
gaagggccaaggatgtgaatgaaaccttcagatccgaccttcatctccttcatcctctgtcttcttctggaaaatccagcgttttttttctttctttgttactgctgaatcgaacgcataccagtttaatcatttgagttctccggcgagtcacgagttttccgattgagcctcgactactatttctattggttcttcatcgaaggtcgttcgaggttgacgcatcgaggtctccggtgctggttctctcgccgggagggtatgtgcccttggtcagtcttttgcctttgtgtcatgttcagaagtattactcttcatgtttgatgaatcgtttgattaatattcttgtctggattgcatcgtagtgatttctgaaattctgtttaattttgtgtcatattgtattatgttatgttcaaaa

SEQ ID NO: 1607 - DNA, 374 bp, Nicotiana tabacum
gtcccgaccaatatttggagttccctccacaggggttttagtgcataaacgccatggaatgtgcagtctcacactctgatgctggtattagtgatgctacccttatcaatatcaatattcatgtcctgtctgtaaatagtgatttgatgctggtattagtgaagtttaccgttattggtatcaagattcatgtcctggttgtaattgttgctctgttggcataatggcttctctgtaaatacagctgaaaagcacacatatattgtctggaatatattgagagcacatttctcattgtaagcaaatggtaaagtccttccttatgtaggattttggttcttttccaggaataaaaataagagtcaaacccaaaa

SEQ ID NO: 1608 - DNA, 447 bp, Nicotiana tabacum
ttttcaaacatacaaccaatgtaatgactacaaacactaataaatgaaacagcctatccagaattctgtactgaagcacacaagattcacgaaagcttaacaaaaaaattacaactttagaagtaacacatcttgattcatagaagtaacacaactttggaagtaacacatctggatatcccattagcagaaatgaaagttccacatctttaccatgtgggggaaagatcagtcattcttggtaaggacccaaatagcatagataataccaggcagccatccaaagagagtcagcaaacaacagatccagaattcacacttgcagccaaatttgagaaagacaccaaggggaggcaaggtgatggccaaaagaatgtctatgcaagtcatcgcacccatcttttttattattcaatagaaattacagagggaaagaagaaaggacaa

SEQ ID NO: 1609 - DNA, 397 bp, Nicotiana tabacum
ttgtttaacattgtcttcttcttcattgctgccataaatccaggaactggcaaatttgtcactgatgaggaagaggagtgaagacagaccagttagtttctgtgtggcttttgtgtagctttttccaataaacttaatttatatttcttctaacttgtgtgcactccatcgcgattatcttatttaatttccagaaaaataagtaatatggaagttcaaatgattggaagttgaagagtaccgtaaatggctactgtgatgataaaacaattctgtcacatttcctctcacggttcatgaagaacttcaaaggtcaaagaaaacaagtgtgattatagcaatctaaaattgggcttttttccttctatatacaatatttcaaacttatttaccaaaa

SEQ ID NO: 1610 - DNA, 448 bp, Nicotiana tabacum
ttttacagcaaaaggaggctcaagccacttcatcgaataacaaagtcaggggtccaaaagcaaataccgtactcacatatttactaacacaaaagattgttcatacgattatatattccaaatttatccccagattatgagatttaaagttcactcaaatgcccaagcattctccctcctaacctcctcttcttcctctggagtgaagtcattcttgatgttaaaggtcttccggatctcctctggtgtcttccctttaatcatgtcagccacagtttgacatgtgagatcaagcaggctcttgatgttcaagtagttggcagccaagatgagatcgaatagggtggcctggtcaactttaacgaaatcagaatcaaagcccttaagctcatcctcagaagccttatcctcagttttggtagcatcaacatggcgcttgcagtactcg

SEQ ID NO: 1611 - DNA, 494 bp, Nicotiana tabacum
ggtgatggtgccggagatcataatcggcagctcaacgcccagcgcttcaaactccgttttcaccgcaaataccgccgctttggcgttaagggtgtcgaaaacggtttcaatcaggatcagatccgcgccaccttccaccagcgctttggtggactctcgataagccgccaccagcccgtcaaaagtgatattacgaaatgccggatcgttgacgtccggagaaatagacgccgtgcggttggtcgggccgagaacaccggcaacgtagcgcggtttctctggcgtgcgcgcggtccactcgtcagcacaagctcgcgccagtttcgccgccgcaaagttgatttccgccgacagggattccatctggtaatccgccatcgcaatggtcgtggagttgaaggtgttggtttcgatgatatccgcgcccgcttcaaagtaggcgttgtggatagcggcgatcacttccggtttactgagtaccagcaggtcgttgt

SEQ ID NO: 1612 - DNA, 505 bp, Nicotiana tabacum
ttttaacaaacatattagataatggcttttattcatacttaatacagcaagctctgaagtagaaagagcattactattacagctttgccattacaaaggttttatatattacacgatgatcagtgttgaggcttcccttcagtcactttatccatggcctcacctttgtagtagcaacacctgctgcagccgtagtaattgcggcggccgcaacaaccatagcggcagtatcctccacgtccaccaccgcggccgccacctgggtatccaccacggccgccaccagggtatccaccgccaccacggccgccaccagggtatccgccgccagggtatccaccgccagggtagccaccaccggggtatccgccaccatattgagcttcatgcacttcattcttgttatcggatttctttgagtcctcttctgaagtggtggaagtctcagacaactccctagctaaaacctcagagcttatcattataaaaatggccaaacaaaggc

SEQ ID NO: 1613 - DNA, 432 bp, Nicotiana tabacum
cagagcattccgtcctcagcaggctaccgaacactgaaacttagctttacagtgatgttattccagaaaaacgtgtacgaagtactaagagatgtggatatacagaggagagttggaatgatattggtttccggttcagttgctgtggacacaatcatttaactggtggtgtaagtgtatattcatatgattcagcacagtggattcttgaaagagatatagtgagcttgattttaatttcagtgcgagaagtatttgtgtcatttatgtaaggttgcaggttcacccctattgatcatcttgtagatccttttgtaatactccctccgttcacttttagttgtccactttagacttttcacgcccattaagaaacaaaaatgagatatgtattttaaaattttacctataataatgatagcatttccaaaa

SEQ ID NO: 1614 - DNA, 510 bp, Nicotiana tabacum
tttttacacaatcaaataggtaagaatatcaaaatatacaggactaaactggaaagaaaaatcctagtaattaatcgccagcacaggctgaccttggcctagatattttcaacaaaatagacaaattgaacttctgttacagtagcttgagtggcaaaaatcctaacagttctgttcattggaggatgtatgcaaattccgtcttttgcactgccacagcactgctgcaatcaagatcggaattcccagtagaaatctcagcaccaaaactccacctattcctataccgccaaagaacaatacaaaaacagaatagtactcgactttgcatcggaacgtaagtttcgaaacgtgaatgtcctctttgcaccaataacggcaagtagctctgtcgctgttttcttcaatagtgcactcgccgccccgatccgaaacaatcgaatcccgcggccgccatggcggccgggagcatgcgacgtcgggcccaattcgccctatagtgagtcgtat

SEQ ID NO: 1615 - DNA, 405 bp, Nicotiana tabacum
tagactctgctgcttacaccagattgtatctttttggaatgacgagttctctggggacgcaccctcgtatctgttcattaggaggtccagagcatattttgaaggaaagaagttgcaaattttcatgttttcgttatacagacgtagaatcttcttggaaagaattgcttccttcaaaaggtcagaagtttattagctatcgccacctaaatactagaaaaaactggtcaattttttctgctgcaactggtgatgcaaaggatccggatgactcagaagatagtaacaaaccgacagaaagtgaaactggatctgtaaatagtgaaattttaaggaataatcttgaaagaatcatcgggcgagatgactctgcttttagtggaatagaccttgcagctctgataa

SEQ ID NO: 1616 - DNA, 441 bp, Nicotiana tabacum
ttttggaactaaaagcatattcagttagaaaatcgtagcaagaagtagtcaatgactcttcaatacaagagatctaaacaaataaaagaacttccaaaatatacaaagtactgcagcttattatatctccaaagaacaaaataaaacaaaattacaaagcaccaaaattaatctaaaaatcaaagccacccatatctcccatggcatctccgtagccatcatcataagcagccatctctccaacatccgaaaccatatctcccaccaacaaaccaccaagcaatccagcacccaatcccaagcctaatccacctcccattccaaacttgttctttttcttaggttgttgcaccggtggatatccgtacccaggttgttgtacgggtggatacccgtaaccaggctgtggttgcggatatccataaccaggtgcaccaccag

SEQ ID NO: 1617 - DNA, 389 bp, Nicotiana tabacum
tgctgaaatcaactgaaggtcacttcagaaatggggtgcttgatgttaaggacttattaaaaccttctgcaccaaaagcacctaaagcatttgatgcgaagcagtcttttgctagtaaagggaagaagaaaaagggtggtaaaaagaacaagggcaagaagaaaaagggtcctggtaagaagcgccattaaacatgggataaatggcgagacctccttgttttctttatatttttaagctttagattccagtgtagtagattatatctctaatatcttaaaattttgttgtagtctcctgaattttctgtgttctgatgatgagtgtagtaatgcttaatggatgtacacttttttggtggaagagaaagtgaacattaactgacaaaa

SEQ ID NO: 1618 - DNA, 415 bp, Nicotiana tabacum
ttttagacaaaagtacatgtgactcttattcatgtcttatgtttattacagcaaagatcatctcttgaccacttcaaccaaaataaacaaagtgtgtaaactataaaagcgagacaaaataaattgtcccacactaacgctttcacgcaataattcgaccaaagatgatcttattagaggaatgaccgttctacttagccacttcatcacttccaggcatttccaaggggaaatttgggtgagcttgaccattaggacagaagataaccttataatttgtactaccaccagggcaagtaaaagtgcttgtaggatcatcttgtgggtagctataggcgtcagggcatctttgtttgaaaaattttgagaaaaatgtaggaccacaaggtccttgtgtgcaacaatattgttgtcc

SEQ ID NO: 1619 - DNA, 448 bp, Nicotiana tabacum
ttttcaacaaaataacatgctctgattttaaagatccagaataaattgttgcatgagattgatctcttttccgctggaaaactaagagcaaatctctccatccatacatatacgttaacatagacatactgcaaaaaattagaagagctaaaatgcatttagcggcctcgaccacgtccacgtccacgaccacgcccgcgaccacgtcccaaaggctttccagctgttggcttcttcggcttcaccctaggtgtttcttccaccagcaaagtttcaagatttaagctgtcagggaggatgtaataacgtatgttgttacccctcacactcaggtgatccaacgtcactggattctttccctttagtgtaagtttgacagccttcaggtgtgtgttcatgctaacatccacacctgtaatggttccatgaacaacggtgccgtttttga

SEQ ID NO: 1620 - DNA, 270 bp, Nicotiana tabacum
ttttaccactgcaaaaagactgatctattaatcatgttccttgggaatatccaactatcaataaacagatacaagcttaactgttagttgctcccacttccagatagtgttacatccgtatcgttttcttctgaactaaattagctacaatgctcgctaaacctaattataactataacacaaacaatcataagggggcgaggaaggtggcaaaagaataagactacataacgagatatattacacagctaattctacgtattagctaaa

SEQ ID NO: 1621 - DNA, 523 bp, Nicotiana tabacum
catagtggtagatgaagattacgtgtttcctcaccctcaatttccctagctattcttgaagcttctttttccaactccctcatttgaggacctttctcaagctttgtagtataaagttcctcattgaacgtgctttttactccaaatagtgtttcattgacctcaaactgatcccagcccctgttccagtggccatcaaatatattatccagttcaggacattcaagagcatcgtcgtcaggcacccaacgttccaactgcctctctacctcaacatgctgggactgtgatatgcatgaatctgtcaaaagctcctgctgcttttcccgcagcaattcggcttggaggacatctaaagttacaggcacaccctttgcgataacttgcacaagctctttacccggtattatcaaagtctttgttggaggtttgatcaaagattcaggagtattcttcctcccctgggaaccatcttttatcaagtgggccattttcagaataataccaaaatctttgtcagcat

SEQ ID NO: 1622 - DNA, 161 bp, Nicotiana tabacum
atttattgaggtgaactcgtcctaagtttgttcttgttcctcttttaacataatctgtacaaattgagaaggaaagatggtacatatgtacctcttttaacatgacctacacatgctgctactgaatgataaaagcttggggctatattatgatactttaa

SEQ ID NO: 1623 - DNA, 468 bp, Nicotiana tabacum
cttcatcttaccaccgctttcctttatcttcgtctgtgactttcttgtttctctctctcgctctcgctctctctgacgtatataaaggtaggcctttagggggacatggcgattgcagtggcgactcaaccacaccaactcaaggtaacaatagaataagacaattttggaaaaatcaaaaactattgaacttttggatttatattgaaaatttgtcgcgagcttaaggattttaggattttaacctattgaattatcagtattctcttttattcgatttcaatattgcgatgagcttgaatttgacatatttgtggcatcccttttggagtaataaattttttctccattttcaatttgtggtaaataattagtattacatttattatttcagcttaaatgacagatttttggagcagaatttagtatacattggaaaatttgcgaaaaatcttcagtttacctgag

SEQ ID NO: 1624 - DNA, 202 bp, Nicotiana tabacum
ataaaatagcctttattatcaatcaataatacaataatctgaaagaataagcaaattacatataaaaaaaattactacacaagtcatattagcagagcgccatgatcacatgcacggcccgttattatacaatcgaagaagaaaaatatttacgtactttattacataataacatgtattgaattttttataataatctttt

SEQ ID NO: 1625 - DNA, 493 bp, Nicotiana tabacum
tttgaaagaaaaaatgtggtaaacattagtctcaaactgatccacatttgtatttttatcaaatgatcccattgagaacctgtaacctctgcagtgaattaagatccgccaaaacaaaacggtaaaaccccttcaacaagggaaagggtgtggggtttcaaagatttaacccgctctaaaattttaaattattacagaaggcaaaggaaaattggtaattgtctccccaaatgaatcctcaaacgtaacaccaaaaagattttcatcaccatctatttctaaaaaggatgtttagaggctggcttaggcaccaccggatccgtatttctttccaaaaacaatgacctgaagcttgtcgtatccggccaacacaccagcaccagcaacagctcggaggatgtcctgcaccagcacccttgaagagggatttggcaccctcgttcttaacaatctgggagaatgcatcgaacgaactcttgtacttaacggcctc

SEQ ID NO: 1626 - DNA, 541 bp, Nicotiana tabacum
gcggccgctctagaactagtggatcccccgggctgcaggattcggcacgaggggcagttcttactcaagagcaaccacattttgtgttgtttccttatatggcacaaggccatatgatacctatgatagacatagctcgattattggcgcaacgaggtgttattatcacaattcttttaacaccctcaaatgccaataggttcaatacagtcattgcccgcgcaatagaaacaggactaaaaattcaagtaattgacctctattttccaagctcagaagcagggctaccagaagggtgcgagaactgcgacatgcttgcatctatagatatgatgaagaatttctttcttgctgctcaaatgcttgagtcgcaagtggtagacttgttgcaagaattgaatccattaccaagttgtttaatttccgatatgtgttttccttggacaactaatgtcgccaaaaatattaacattcctcggattgtttttcatgggatgtgtagcttttctttattgtgtttacacaatttaagagaatggaa

SEQ ID NO: 1627 - DNA, 250 bp, Nicotiana tabacum
aaagctccgatcctcccgacttccgatcttccagctgattttgactggcgtgaccacggcgccgtcaccggcgtaaaaaatcagggctcgtgcggttcatgctggtcgttcagtacaacaggagcggtggaaggagctcactttttggcgacgggagagctggtgagccttagtgaacagcagcttgtggactgtgaccatgagtgtgacccggagcaacaagatgcttgtgatgcaggttgcggtggtt

SEQ ID NO: 1628 - DNA, 441 bp, Nicotiana tabacum
cctcgtgccgcttttctccaaatggaacgtctatttctcttatctcttctcgctttcgtacttttctcgtcggcgatagcgttctccgacgaggatccgttgatccggcaagtcgtgtccgaaaccgacgacagtcatctgttaaacgccgaacatcacttttcacttttcaagtcaaagttcggaaagatctacgcttcggaagaggaacatgaccacaggttcaaggtattcaaggcgaacctccgccgtgcacggcgtcatcagctccttgacccttccgccgaacacggtattacgaagttctccgatcttactccgtcggagtttcgccggacttaccttggccttcacaaaccaaaacctaagcttaacgctgagaaagctccgatcctcccgacttccgatcttccagctgattttgactggcgtgaccacggc

SEQ ID NO: 1629 - DNA, 230 bp, Nicotiana tabacum
tttcgtgcccattaatctgcttcaagcgtcaggatcacggagtgctcttggtaggttatggttctcatggctttgctcctatcagactcaaggaaaaggcttactggatcatcaagaattcttggggagaaaactggggagagcatggatattacaagatttgcaggggtcacaatatctgtggagttgatgccatggtctctactgtgactgctgcccatactactaat

SEQ ID NO: 1630 - DNA, 359 bp, Nicotiana tabacum
ctcatctatgttaagctttacacatatcaagtatttagagggctcgcttacatgcatactgttgctggtgtatgccatagggacttgaagcctcagaatgttttggtagaccctcttactcaccaagtaaagatctgtgattttggaagcgcaaaagtgctggtgaaaggagaggccaacatctcatacatctgctcgcggttttatcgggctcctgaactcatatttggtgcaacagagtatactacttcaattgatatctggtcagctggctgtgtccttgctgagcttcttctgggccagccattattccccggagaaaatgctgtggaccagcttgttgagataatcaaggtgct

SEQ ID NO: 1631 - DNA, 260 bp, Nicotiana tabacum
agaaacttgctgaggagagccagagaccggtgtatccatttgcagctatagtgggacaagatgaaatgaagttatgtcttttgctgaatgtaattgatccaaagattggaggtgtgatgataatgggtgatagaggaaccgggaagtccaccacggttagatctttggtagatttacttcctgaaatcaaagttatttctggtgatccgttcaatcagatccagatgaccaagaagtaatgagtgcagaagtccgtgaca

SEQ ID NO: 1632 - DNA, 260 bp, Nicotiana tabacum
ttttaaaactgaaaactgaaattaacaatataactgaaaggcgactattggaacaagtgttgattatgaattatacagataattaaatcgacgagataaatatgctagtgcattagggttgaagaagtagccttttacattgaggcatcaaggaaagcatcagatacatcatcaagttccacattcagattttttgcagaaggcaatccagccaccacattatgttcaatgccacactcatttgttcctcttctgatctt

SEQ ID NO: 1633 - DNA, 264 bp, Nicotiana tabacum
ctttcactgagagaaaaagagagagagagagagagtgggggtgggtgaaggctaaagaggtttgggattgacgaggcaaggaagcgaaaatgggagctggtggtaatatgtctgttgtaaccggcaagactggcgaaaaaaagaatcctcttgaaaaggtaccaacctcaaagccacctttcacagttggtgatatcaagaaggccatcccacctcactgctttcagcggtctctcgttcgttcattctcctatgttgtgtatt

SEQ ID NO: 1634 - DNA, 321 bp, Nicotiana tabacum
ttttgaactgcaaaactgactactgaggaagtcactcaagaatagagcacttctcagcaacctgcagatacacaacagacacagtcctcgtcgtgcttctactagcgcaaaacaaaaacaaaaaaacttactaaatttactcaagaaacccaaggggaaagatagaattaggaaactggctactgagaaagccaatcaagagtgaaacactcctcagcaacctgtacacagagacctgggatagccttctcaacatcattccactgacaaaaaacttcattgtcacaaattacacaactcaacgattcaagaaataccaga

SEQ ID NO: 1635 - DNA, 580 bp, Nicotiana tabacum
ttttagggacaacacaaaatgctaattattcatgaaaatatcagttatatttcaaaacattgaaataaaaatagagtagaattaaagagtaaacaactgacgacgcaacgtccccaattatcactttcctcgagaatcaacaatggccttattcaaaactgaagccacttctattatcgcatacactccactccccatatgttgaaaaggcaatttaagtaaggcaggagtatgccaatgctttttcctcggatagttcctcagctgttgcgtccaacttctttcttgagaactcatcaattggaagaccttgaacaacacaccattctccatttttgcatgtaactgggaaggaataaataagcccagctgggacattgtatgacccatcagagtaaacacccatagaaacccaagttccctctggagttccaagaacccaatcacgtatgtgatcacaagcagaactagcagcggaaagggcactagaaagctttctagccttaataatggcagcacccctctgctgtacagtagaaatgaactcaccattcaaccatgcatcatcagccacaagttt

SEQ ID NO: 1636 - DNA, 444 bp, Nicotiana tabacum
gattagccaaatttgaactcaaatggagctaggaaccggttacaaaagggaatcgttgagagcagaggaactacaatagtgtaacttaaaactaatactcaacccagccaccacacctccgctacataaaaaaactaacaatatttacaaaaacagagccacgacaagtcggacacgtaacatatatagagtcaagcagctgaaacatgcatgttgagcctcgattcataactcacaggtcgtaaggaggaggagggcttctgggtccaatcccactagcattctcgtatgcaaatgaccctgatcgcctgcggaatcgaaatgcctcctttcctcccgcaccagcaaagggagataccggaggagtggaaccggcactggcaggcgaaactggaggagagtctttactcacatatcctggaggctttactatcattatacgtt

SEQ ID NO: 1637 - DNA, 412 bp, Nicotiana tabacum
ggcacaagatgttgatcttggcaacatcgcttctatgactactggtttcacgggggcagaccttgcaaatctagtgaatgaagctgctttgttggcaggaaggcagaataaagttgtagttgaaaaagaagatttcattcaagctgttgagcgttcaattgcgggcattgagaagaagactgccaagctgcagggcagtgagaaggctgtagttgcaaggcatgaagcagggcatgcagttgttgggactgctgttgctaagcttctttctgggcagccacgcgttgagaagctaagcatattgccgagatctggaggggctttaggatttacttatattcctccaaccaatgaggacagatatctgctctttgttgatgaattacgtggaagattggtcactcttcttggg

SEQ ID NO: 1638 - DNA, 449 bp, Nicotiana tabacum
ccgcttgttcccatgcgagttgatagattcggttttgtgaagcaggaacatagccctactgaaggtttagcaaggagccggtcggcctttgaatatcagagagatgagagaaggattaggaaatggagaaaaatgataggtgttggaggaagtgactggaagcagtatgttcggaggaaaccacatgttgttaaaaggcgaatacggaaaggaatacctgattgtctaagggggctcgtctggcagctaatttctggaagtcgggacctcttgctacttaatcctggagtttatgagcaacttgtcatatatgagacatcagcttccgaattggatattattcgagatatttctcgcacctttccctcgcatgttttctttcagcagagacatggacctggtcaaaggtctctttacaacgtttctgaaagcatatttctgttctttga

SEQ ID NO: 1639 - DNA, 546 bp, Nicotiana tabacum
ctgacgagttacgatcgtcgtcattccttttctttttgttatactccatacgttattgcattagatatacatacatacatacatatggtggctaatattgtagacaacctatatgcctcatcacagggccaccaattctactagatagagcacaatcctaggcttatgtcatagctgccagtgcaagaaaccttatttccacgtaacgacatacataattaaccattatatatttatattttcaagcgcttgatcagccagatatatatcctctcacatatttaacgtcttctatttaactttaagcatattaagtctctctttaatccaagaaaccccaactttagcatctttagcacacttaatatgtgcaatatagccagtatccctgctataatacaaccaaccttccttagacaccttcttgttacaaacattgcatcgcgcaatccaatgcatgtgattgttgtcattgataggaaacgagtagtaaagtcgaagagtatcctttggagaatcagctctcctcgcgatgccatataatgt

SEQ ID NO: 1640 - DNA, 388 bp, Nicotiana tabacum
cccaattattccgtttgttcttttccttggggcatcaacctctttttgggctttttattgggtattgacctgtggtggatatgctggaaatttatctcccaagtcaagttttgagcttctgaaaggagacaggaatgctctactcattgatgtccgacctgaggcaaggcgctctcgtattttctgcagaatagtttgtgccaagatgttctgtgatctttgttctgcaatgtttttccattacatttatcttagtaaataatgttcttatttgatacatgtgtacgttgagggtaaagacgaacaaatgtcccttatatctttcttcttcctcttgtatgcttttctgaaggatctcagagagaatgaaggcattcctgatcttcga

SEQ ID NO: 1641 - DNA, 330 bp, Nicotiana tabacum
ttttagactgcttgatctaaaattttcaataactttgcgaagattacagcctgcttttcttgtttcaagaacatcctgaatcaactagtatgtatataattatctatttgttatatatacagcaggaagataatgtagctcaccagagctttgtacaaaggaaagaacatacataggatgctgaatgggatgcatctaaaaaaccatttcagttccatctcttggagttctttgatttctttgacttctgttttgctgcttggaatgccagcattttctgttttttccgagcttccctttccgcctttgacatcttggatttcgctttag

SEQ ID NO: 1642 - DNA, 304 bp, Nicotiana tabacum
atttattcatattcaatggatatttcaagacaaatatagggttcgaaccaaagctactgggttcgatcgaacccgctcccgacactctagctccgcccttgatagtagaaagagttactaggagtcgaacttgtggtgttatagtttgaattgtgacaccttgatcattgaacaatttcagatattcgagtttaatagctagctagtttttatgtctatggtagtacaccagttgagattatagtcgagggatgtgtaaagattttaattacattgttcactattttattaatttgtttgaaat

SEQ ID NO: 1643 - DNA, 481 bp, Nicotiana tabacum
ttttgtgaaagagttttatattgtgtagagaaagttaaactcccaaattcaatccccaattgctcaacgcacaatgattattacatatgaaaacgagacccgttaagtatgaaacagataacccgaaaacccgacaacaatgaagaaaaccccaagaacataaacccggcgaatcccaaggcaactgagatatctgattgtacacaaaatgcattattagccgtacacgtgtctctttcccttaacgtccgagctaacgccgttcccgccgaatccgccgacagcagcatatatgcgaaaacctgatcgtggctaaaatcgaaccagacttgaacaacttcgggaaacacagtggcgcctcttgaaatttcccaaactgaagctccaatttcaaacagtgaatacaaagccacaatcgcagctgcaattgcgacaaacctgaaagcatcgaagttgtaccactgaggagaaccggagccac

SEQ ID NO: 1644 - DNA, 417 bp, Nicotiana tabacum
gggttgtgaactaaaaagctaggtttctacttcaccaattatcaatccacaattaacttcctgtctatgcttgagaatgtctggtaaaatgccttgaagtgcttgtatgcaatatcaatatcttcctttccgcatatctctctcacgctgtgcatggatagctgagcaataccacaatcaacagtacgaattccaactcctgaagcaagtatcggacctatagttgatccacatcccatatcatttcgcaccacaaagtcctgtgtcggaaggctgtggagtcttgcaacttctttaaaaagaaaagaggtaactccactcgtggcatagcgttgatttgcattatgcttgattacaagccccttctgtaattcaggacgatggtgctcctcatgcttatccacaaaattagggtgg

SEQ ID NO: 1645 - DNA, 223 bp, Nicotiana tabacum
attcaatgccgcttcagttctcttagttcttcttcttattaccatagttacggctaagaagtccggtgatgttacggaattgcagatcggtgtgaagtttaagccaaaatcttgcgaacttaaggctcacaagggtgatagagtctcagtacactacagtggaaaacttacagatggaactgtatttgactccagctatgagaggaatgaccccattgagttt

SEQ ID NO: 1646 - DNA, 364 bp, Nicotiana tabacum
ttttataaaaagccgcatttatttatcgccaaacaatggagtacatggaaacgttaaccatacagctccaatttattatttggaggctacatatatgcctataatcccttagccaacctggggagtttgtacaacaaagtccaatacattaacgaaaagacgaactcgattacatcttaaatcttctgtcacaggagtaccattaagtactgtttgaacattagttagttttggattttccttctgaattatttgcatagcaaactttgctggtgttccaagaggttctggccatctttcctttgtcactcctgggcaaccagactgagacacatcaagttgcaagacattgatttccaaatct

SEQ ID NO: 1647 - DNA, 471 bp, Nicotiana tabacum
ggaattcaagctttttgcatgtagtctcaaaccaagattcaatccccagattcttagtctcacctactaatggcttttctggttctactcctcagtcttgtgtttacaggccatttggtacatttctgctgtgttcagattcagactactcttgttttgaggaatctgaatcagttttggatcttatgatggtaatgaactcagatggccaacaacaggacaacggtttcttgattttcaattatgggccgattctggaatgcctcaagcatagagtaatctgtaagggaacttctcagctgagtgactttggagtgaatcaacttcaagcaggcatcattcaacagctagaagcaattggaattggcggacagtggcagcaaacaagtaacatgagctttcttaggaacatggagaacagggtggaagcatctttcgcgaagaagatgaatgcttttgatcccggcaagg

SEQ ID NO: 1648 - DNA, 378 bp, Nicotiana tabacum
ccaccgtagagggcggaggagggctgccggcggcggctaaagaggcggcagaactgaaaagggagttgcagagagcagtaaaggctgtagttgaagacgatgattacagtttagaagtcaccgatcgagccatgcggtgtttatgtgctttaaaagaattgaaattgaaacctttgaattcaaatcctttggatattcgtagcctttctttgagtttaccaattccaccccatgaatttgtttgcccgctttctggtcagcttatgaaagaccctgttgttttggcttctggtcagacatatgacaggccattcattcaaaagtggctgaaggatggccatcgtacgtgccctgaaacaaagcaggttctttcccatt

SEQ ID NO: 1649 - DNA, 352 bp, Nicotiana tabacum
tttgtttatagcatcatatcaatatccctcaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcgggg

SEQ ID NO: 1650 - DNA, 495 bp, Nicotiana tabacum
ttttttttaaaatatcaaaagactactctgattactacaaaaataatggaggaataatcgctttatacaatcgtttgctcttcttatacacacaaaaaatcacccataagggaccctaacaaaatcgtcccctgtacctaatactacagactccgggtctcacttcttcccaatgaggaaaaagaatcaaagaattatcacaatacaaaaaaagaaaaaaataactcgtatacgctaaaagcgtaaaagaatttttacactgtcacatcacaatctccgctagtgttggtcaaaagaatcatgaaggctcggtctatacaaatcataaggtgcccataaaaaatcaacaggacaaggattttcttgatcaagcctaacccaaggtttacctttaccactccaatgcaataaactaactggacctggatgcaatgttctacaactattcaccaaattatctccacctaatccatgttgattccatttatgatcaat

SEQ ID NO: 1651 - DNA, 530 bp, Nicotiana tabacum
ttttggagatcatagaatcctctaagatgttcattacataaggagccaccaaattcagatgagagcacacacaaacttcaggttttaagagcattctagctaagtggcaaaatctctgagaccagcaaaagataagcttttgatagagcataccgtgacagacactgatcatcatcaatcaaattgaaaaccattgaatgggtacagttcatcaaccaacaagctgtactcaaatacacaacatagaaaccaaagataagatcatgaaaatttcacccaacaaaacttatgggttggcatagtgaaaaaggaaaacattcacctcctctttagtcaaagaaaaatttagcattctcgtacttaacatcaatactcagatggagaaatcacgtcatcaatctttagaatcatcttgacaacctgagttgcaagcaatatctgttgttgcttcccaattaaagtctcgaagacattttgctcccgcatgtcatttgtgccaacatcattgcagtctattccacagcatggat

SEQ ID NO: 1652 - DNA, 553 bp, Nicotiana tabacum
gccactgataaagatgatgagaacatcatcacaaatgttgctgtcgcactagctacctgagggataactccaatctcaagaagaagaggaccaagaatgaatccaccaccagatccaagcagtcctccaacagtgcctcccaatatgccacaaagggcacagaagataaggtttgtggcagtccattgaatgtcagcctcacatattgactctgtattcccgtctagtctcctcttcttgctttccttgtacaatttcacacattcatacccaaacactgcgaatgctactgggaactgtagtaagttgagcacccagtacaatggagtacaagctactagattgttcttgaacacttgaagaatcagaaatatgaaccatactagaaagagcaccataattctcttcaagttaaggttgaacctaaaaatttccagtggtgttttctcctccctaggaaccaatgactcatacattgtatcaataacaacaagttcaccacgtgaattaactggaacttcttccattgatttcttgagaatagtttcttctt

SEQ ID NO: 1653 - DNA, 401 bp, Nicotiana tabacum
tacaatcagggacaaaataagatcagacgactcctagtgacgtaggcaaccagcaataattatctcaatgaatctaagcaatgcaaatggcctacatttcaggagtcgcctgagattctttttgtctgcgactgttgtgcttcgaactactgtgggttttcgttgatttttgtccataaattaatttgtacttcagcaatcacgaaaaaactacgcgttttattttactttctttcttcttccgacggcagttatttactatagaactaagaaaaaaacttaaatgcttcagttttaaatctttaatgcagtttgatgtactgataattacaactggcctaatgttcaaagatgttttttgcgtgttgaaatatgtttattgtttcctcttctctgtgatt

SEQ ID NO: 1654 - DNA, 360 bp, Nicotiana tabacum
gtgaaaggagacccggcaagacaagcggaaacgccgaaggtggcacagtcacatgcaactcaccaccaccacgcgcctacccttaacattagtgacagtgccctcaagttcacgcacattctctacaatctctctcctgctgagctgtatgagcaagcaatcaagtatgagaaggggtcatttatcacgtccagtggtgcattggctacactttcgggagccaaaacgggccgttcccctagagacaagcgtgttgttagagacgaaaccactgaaaaagacctttggtggggaaagggctcgcccaatatcgaaatggacgagcagactttcttaatcaacagagaaagggctgttgat

SEQ ID NO: 1655 - DNA, 346 bp, Nicotiana tabacum
gatagacataacttggatcatgaatcttgatgataatccatgattttacatacttattccatgcatcataataagcttctaagttcttgttgactgtctcaagctgtggatcaacagctttgacagcttcaggtggaagaggtttgaaaccaagcatccaaccctcaaacagaattaccgttaaaggcccttcaacctctggccatgtggagggatcagctctgtcacctctcccattgtacgcagatttatcatatcgaggaagctgtcatcttcacaccttcttttgtcactttgcttagctctgccagtgtttcaacagacaatgagagatcatggcttccag

SEQ ID NO: 1656 - DNA, 299 bp, Nicotiana tabacum
caacttaaacgtgatgcaatatagaagatcaaaagctgactcattttctgcaagaaacttcaagaaagtagctcccaccagatttctgggttttaaagcttccagatcgagcatctggataagcataaatgtgatgttgacaccagcaacagcgaatgggtattcccaaattgctctatcaccttcctgctttcggagaagatcctggaaagatttcgggaagttccttgcaaagtataacagattctccagcgatataaatccaccacccctaaagtcagtagaaggatcttttcctt

SEQ ID NO: 1657 - DNA, 403 bp, Nicotiana tabacum
gaaggaagcaaggtccattgaattctgtggctccaacagaacgagcacaaatttcttctgtggacgatctttatgacttcatatgctcaggccccctcatcaataagataggtctgacacccgaaaaagtggctgagtccattgataagtggatagagtatggatttcgcctttgtagattgtttcagctcaaccagctggctctcaacgagcctcaaaaaattcgactctaccactactatattccagtcttcttgtggtgtgaacaggaaatttcacagcatagttccaagttcaaagacaacgaagaaatccctccgttggtgattggcttcagtgcgcctcaaggatgtggaaagacaacactcgtatttgcattagaatatctttttaaaatcacagg

SEQ ID NO: 1658 - DNA, 466 bp, Nicotiana tabacum
aacatcagcctcttggagcatgcttacatcatttgccccatcaccaatcgctaatgtattttggtgtgttccaactttcaccaatctagtaacaggagctttttgtttaggatgtggagcggcagcaaataacagatgcacaacttattgcaagctccaagaatgatttttccagttttttgtcaagagcaaatgacaatgatttgccatcaatgatcaaaccaaatgatgcagtaatttctttgcttgagcttatttgtgatattccctctcttatttgctttgtgatgctatcatgtgaaacctttgcaacagtctccttgtttccttggttttctaagtccaatatgtcttgagaatctaaagtaataataatttgcctcatatctggtcttaataaactacaagcgtacccaatattgatagctgtctccatcttatcaccagttaagacccaaatcttaat

SEQ ID NO: 1659 - DNA, 418 bp, Nicotiana tabacum
actgaatctcaaatgtcagtcacccccttcactttcttactagtggcatctcttgatttgttttttcgcttttttgaagatcttttttctttcatttcttcgtgctgctgctcttgctccattgaatcaatctcacttaactgctcgctatttgcaccaatagaaagtctggcatccttgtcctctgatctcccctcattaccttctggctcaatgaccgacattccagttaaagtacagtcaaacatgaacgtgcttctttctaatctatctactctatcgaaatgcctctgagaataagaaataagaccttcaagcagttctccaatacccttaatctcaagaatctcggcaggtgagagaacacagaatgcccggaaaagaacatattgtgcaatatgacaaaactttggcttcc

SEQ ID NO: 1660 - DNA, 422 bp, Nicotiana tabacum
acaattggatttgacagtttattagacaaattctaaagaatgctaggacgcagtattgctatattaggagcttaagtcctcaattacaacctgtatatcagtatataagcacagagaagcactttaatcttggtggctgtcctattgaaattatagtgacagtgtcttcaattcaatgcctctccgatatggttagatataagggcttctatagaatgatatagccaaggtgtataatgtgctttcgtctattcaattctctccagattatacttcacaatttcctcaagtgctgctcggaaaggactagaaggaaggcattttaggctctgcagtgctaaatcagctttctcctttgccaaatcttgtgctcgctgaattcccccggtggtcttgactagattaatggcctcctcaagaga

SEQ ID NO: 1661 - DNA, 450 bp, Nicotiana tabacum
ttttttcagtatttggcctcttaaaccgttccaaaatgaagctgcattaacagccctcttgccgggaagttgaacttccaaaacctctagtgccgtgtccccaccgcaaggaattaccagtgaacctttagtaaaaagcacatcattggcttctatatcttgacttctgataccggtgtaaatccgagtagtgataattttaagctctatactactgctctcgccactgctagggtcaatgaccataagtctagctcgagttccaggccatcctgcaaatgcccgaaccttattatgaagcacttgggcatcttcatcaaaggataaccatgactcctcaggagttatcttgggagctagggtagctttagagtcatcttgctcttctgctcttccacttgcagacccatcaaatatagacggaagttcacgaattagaagtttggaacc

SEQ ID NO: 1662 - DNA, 286 bp, Nicotiana tabacum
ccacatctttactgctcccgccgcgtggagctgagggtaggcggcggctaggttttcgccgtaagggccaccggaatgctgcatcctgcagtccccagctctctgatttgcataattttgggcaaaggccgctaacctattgtcccatgtcatgggaccaacaccaacttgtctacgatgctgcattgtgagggttaagataatcttggggagagttttgagcttgagatgagtgaaataatatagtaaaggtaatgaaacaagcaactaatgttgtggagtatcc

SEQ ID NO: 1663 - DNA, 151 bp, Nicotiana tabacum
actaagcaaaaatacactcttcacttctcttcactaagctgcctctctctttattggtgactcttccccatgacaccatgctagctttcttgtaattgtcactcttactaatagaagtcgtgatcttgacattggccttccagtaccgaac

SEQ ID NO: 1664 - DNA, 414 bp, Nicotiana tabacum
cgcaggcattaatgcaggcggatttgcaacaagatctgcgcgtcgatagcggtaaaccactggtctttcatcagctgatacaggtggcggataaccgctggtactggtatcagcgttatcaccatttgctggtcgatggctttagtttcccggccattacccgccagatcgccaatatttactgcacatggctgcgtggcgaaccaacgcctgcttcgccatttacgcctttcgctgatgtagtggaagagtaccagcaataccgcgaaagcgaagcctggcagcgtgatgcggcattctgggcagaacagcgtcgtcaactgccgccgcccgcgtcactttctccggcacctttaccggggcgcagcgcctcggcagatattctgcgcctgaaactggaatttaccgacgggg

SEQ ID NO: 1665 - DNA, 304 bp, Nicotiana tabacum
  modified_base (79)..(79): a, c, g or t
tgcttcattgagaggtccatggcacgcttaaggcgctggattctggcatcaacaatctcccttggaaggcgattaagangcttccttgacgtccaaatcgtacattggatcatgcagatcatcatatctaagcccgtaattacggaggcgatgcggagagggatttcttgtggattgcagcgagagggttcttctttggatccaccagccatttcgagaacgtcgatgccattgttcgatcgtaaaacacacacccacacgcactgtgtctctgctaacaaaagattagggatttccctttttg

SEQ ID NO: 1666 - DNA, 415 bp, Nicotiana tabacum
tgtgcagggtgaagccagcactcaaaaatcccatgcgcatactcacaagcatctcctcgctggcatgcccccttgcgaaagtctggacaagggacacaactatagtggtattttctagggtcacgccttcttgcgttttcaccagggtgtacaaagggacactctgtccagtcatgggagtaagctcttgagcatggtttcaccttaaatatgtacattctgaagtcatctgtcccatatatcccaatctttatgtccggaagagagggatcaacaggatactctttcttctcgctcccaaatttagagatgtttggagtcaataacagctgttcttctgcttgttcagagataatctgatcgatgagtccacttgcttccccgtcgtcgctgcttcctccaagcaagtgctcca

SEQ ID NO: 1667 - DNA, 166 bp, Nicotiana tabacum
aagatgttctaacaggtgtgcctagcacatttccagagcctctgttcctttcattcctttcatttcgcactttgttaaaaacctcagagtagttttctgcagattggggatcgttctcattccattcgccaaattttggaactacagctcctctatcaggctgcca

SEQ ID NO: 1668 - DNA, 436 bp, Nicotiana tabacum
ttttgaaatataaaactccatcctcttccattctcagtgtaacaaattggcccaaaaaagaaagaaggaaataaggattattccatagtaatattccaagaaatcagaaatcagaattaacagcaaaaccagctgaaaattcaatacattcaaatactattaccacttttgtaaagtttgagcagtcattaaacataaatgtctttcctaggacaaaatcttgccttcccattcaaagagttgacaactttctttgacaatctgctaacaaagtcaccttggtaccgagagacccagctctccttctgaagagcaaataatttcacgttccttcagtatcatcctgtgaaagagctctggaactcctcgatgttgagctcaggcatgacgtcatcctcgccgtagcaactgcgttgtgtagcggcaacattgactg

SEQ ID NO: 1669 - DNA, 114 bp, Nicotiana tabacum
gggtgaagccagcactcaaaaatcccatgcgcatactcacaagcatctcctcgctggcatgcccccttgcgaaagtctggacaagggacacaactatagtggtattttctaggg

SEQ ID NO: 1670 - DNA, 465 bp, Nicotiana tabacum
tcggggcccaccaagcaagttcccggacgacttattgggcccaaccccaacagataaatccttacagtaaacccttataaacctcctccttgctctccaagccccagctttaaacctaaccctagccaccatcctcacatcaaacccaattgcactacttcgagccctttctttattcatcccatcaaaagctcgattctctacgtacgaacctgaagtagcaaaactcgctttctgggcagtctcagcccgtttatcctgaaaaaacggcgggactgtagtgtccgaaagcgaagccgaatcataaaaaaccgctgctgctacatcatcgtagtaaagtgtcaactttttgttggggtttcggacagtaaaacggaggtcccagttggcggaaatcaatgaattggagagattaaggtttgagactgagagcgagtcgactcggaactcggggagacgggggcg

SEQ ID NO: 1671 - DNA, 388 bp, Nicotiana tabacum
tgacttcagctgacttctgttccaattccttgagcttaatttcaacaattatccctccctcattcttttcatctgggcgagggctgacttcaatattagagaagagagctagagaatttatatttctcaaagcctgttttccagcttcaatgttgaaaacttgtccttgacgaagctgcctaggcaattctctccggacaaccggatattgagtgtttccctcacatacatttcccagcttatcctgaaactgaacaaccatttgagtaatatccccttccaccacctcacaaaccacctccttcgtattcaaattcccaaaattcacaacttgggcgcatgcgtaaccattctcatgataccactgctgcactctatccctaatctt

SEQ ID NO: 1672 - DNA, 485 bp, Nicotiana tabacum
aatatcgtgttcttatcaactccgatgtctctatctccagatagagccacgatgagctgcaactaaaccagcgtttccagcaagagtaggctctgtataattgtaattactacggacatcgtggaaaccgtcatgcttgtctggtccagcaaccatggctccaacaataatattcggattagccttagatgaatccctccatttccatcctcctttacagttatacttgaccttgtttttaggaattgacgcccctctgtggtgaacgcgcttagggtagtgattgccaaagccaacaacataactcattttcctgggattcttgccaaggatgtagtcaatctgggtctcagcgaatcgacgcaggacagcagtggagtagaaattgggtccacagtaccatccaggagtgtcagcagcttcaaggtagtcactaaacaaggtagccaggaagctgcattgactacatactgaagaggttgagg

SEQ ID NO: 1673 - DNA, 382 bp, Nicotiana tabacum
gaagtttctcccttactaatagtcatcaaatagatattcacaaattgaaaagacatgtctcttgacaacccactttaagggagattaagaagtaaactaagttctttcgccgaatttattcattcaccaccagcacaataagacattgctgttacaaagtctcagacatgcctggtgacgcctttgccattatcccatagcatatttctgagtccagctacgagcagtggtctcgtatttggacctgtcggtcttgtacatgtgagcaatttctggtacaagcggatcatctggatttgggtcagtcaatagggagcagatggagagcaggaccttagatatggttaacgctggactccactgctcttttagaatatccaga

SEQ ID NO: 1674 - DNA, 408 bp, Nicotiana tabacum
gttgatctcatccatccacgggttcttctccttggctggattaattgaccgtaaagctttccaaactgcactgttacatttgaaacctgaaccaaatgctatctgccaagttcggtctcccctcttgatccttcccttagcttccgagtaggccaattcgtaccagagagagctacttgaggtgtttccgagtcgatacaatgtcatccttgaaggctccatgtgccagtcagtaagttgcaggtttttctctatttcatctaacacagctctgccgccagcgtggatgcagaaatgctcaaaggccaatctaaaatctgggatataaggcttgatcttcatcttcaacagttttcttcccacgagcgttgcgaagaaaagcaactgctcggacataggaagcacaag

SEQ ID NO: 1675 - DNA, 391 bp, Nicotiana tabacum
caaatacatatgtaacattgtaggaaaacatctggtggtcgggcacaattctcgtctgctcaaacagtcacagcagtggtgcagcgacaacttcaagggaagaacaactagtttggcccctgtgctttactctggtaaagtgattctaaacattctttggctctatgaacctttgactgaagataaaaacttccgttcttagcattcctctcaaacaagttatcgtatctctgcaacacgtcttcccatgatgaatgctctgcaaccccaagaatttgcctagcctctgactctgtcatatttttgcttgctcttttgatattctgtactgcttcttgagcaacaccgtttttggacgcatttgcgagagcttgacgatatgcctgggcga

SEQ ID NO: 1676 - DNA, 417 bp, Nicotiana tabacum
gtagtaactcggtttatgttctgccataggagttaatccgcatcaacgtcgtactccatattgctttttcagtcttctaaaagatgtagttgtggatgtagccactcccacctgaagcaatgctaagacattttccatatgataaatatccatcttaacaatatcatgtaatcatgtttcttgaactgagtttgtctccgagcaatgtaactttccagcagtccacttgcagcataaatacagaaagcttttttggtacaacttggaatttgttgtcttctgtgattattccaaatgtttctacggtctcacgaatcatgataccatgtacaccacttaagccagctattttgcactgaacaactagaattagtgcaccatgtaagtctgcattaaggagacattgtgataactgat

SEQ ID NO: 1677 - DNA, 187 bp, Nicotiana tabacum
ttaaatcccaagccgtgaagggttccgttctgatcacaaaagcccaaggcaggttcttctctaacggctttgatctaaagtatgcacaagccgctggttcagcgcaagctgccaaagatcggctacacaacatggtggccttgttcaagccgctggtcgccgatttcctatcactcccaattccgac

SEQ ID NO: 1678 - DNA, 362 bp, Nicotiana tabacum
aattaaataaaaggcgcaattagttcatgtaaaagatgggaatcgagtgcacctctgtgaaaggaacactttacattcatcctttggagcaatggttggaatatacgcgatatcatcacagccgtccgttttgtgcctcttgaaatcaatcagatgccgtgaacaacgcaataaagatgcatcaaatggtttatagcatacctctgtcccacacatccatggggcccagctccaaatgctagataattcttcttgtaaacccgttcctcttgcctctcctctgtgaaccggtccgggtcaaacttctccggttcaggaaacccctggaaagacgagtcaaaaaccgaagggaaaacaatagt

SEQ ID NO: 1679 - DNA, 399 bp, Nicotiana tabacum
tgatctcaaccattttccgacggatctgacggatctggctgctctgagcataacatgtccgcttctgctggtttggacgtttctttgtaaaagcaatgcagaacatcctgagagtgtagctatctgtagtcttgacatccacatgagcctcaatcaatgtctgccacttctttaccagagacctcaacttgtctgttgtgaaatccattccccagaagtttgtgaggacattcttcccttgcacatcttctgccctcaagcgaatcttcctgaaagattgatcctcatccttctgaagatcagccaaactgacttcaaatactctgtgttttagtccttccgaagcaatcttagtaccctgagtcctagtgaccagggtcttgccaacgttcttgatat

SEQ ID NO: 1680 - DNA, 182 bp, Nicotiana tabacum
catgtatcaaatccatttaccacactagactttcagacttttgggggaaaatatggccatgatgctattgcagagttcgtattttatacttagcatgtcttgttattgcagctaaacagtcccgacctctttgacacatattctgctggaatagtgcttctgcaaatggcagtaccgaacgg

SEQ ID NO: 1681 - DNA, 174 bp, Nicotiana tabacum
gtgaaagaagaaaagttaaaagagaaaatcatggagagcgcgttgaaggagcagagaggaggagaatcggtgcttgacctgtcaccgagagcaacaccggcgggtggtgtcgaggatgtctacggtgaggattgcgccaccgaggaccagcttatcactccctggaccatcgcc

SEQ ID NO: 1682 - DNA, 259 bp, Nicotiana tabacum
tattaacttccaccgacgacaaacgacaaacggcaaacggcaatcggaatggggcaatcttcatcggcggagcaagtgtcgccggagcaaagagaggcagaatctttggctgcttcaactggagctcttccttctctacaaaaagcattctctctcctttctaatcctcaaactcactccatccccctccattcccttcagaagtgttttgggttctcctttaagggatcaacaagtgaagaatcgacagtaccgaacg

SEQ ID NO: 1683 - DNA, 230 bp, Nicotiana tabacum
gtttttgactgatttttacacaaaacctaaacaccacgccaccaaaagtaggccctcgctctggtttttttattacagagaaaaagaggaggaagagcatcagcatccatggctcgccaagccacaagactggtctctaagttgagttcaaagcttagccctaatagtcccacgatctctgcttcaccatcttctccattgtggcatcagtaccgaacggatcttccagt

SEQ ID NO: 1684 - DNA, 289 bp, Nicotiana tabacum
cagcataaatgcaatggaaaatatgatatagagagtgaaataatccagattattactattgttcatgctactaatggcaatcctgtcaaaactttcaaacaattatagcaaacaaaataatgaacaatagtaacaagaggcaacgagctaattagctgtctataattacaccgcactatggccttactgatcaattttcactcaaccacaaccttcaccttcggtttagaaaggataattttgaccaggtcgatgtatgtaacaggtttatagaaataataaccctgct

SEQ ID NO: 1685 - DNA, 265 bp, Nicotiana tabacum
gcaaatgcggaacaaaaccggattctcagattgaccggagaagcaaggaaggaaactaacagcacatcatcagccatgggttccgatcctgaaaagttgatgaccaaagccgataaactgacaaaattaagtttaccaggtggagtagcgattggagaagtgctactgttttatatgagcaggcagctaatggatttagggttgctaaaagttatgagaaagcaaaagaagcatttgagaaagcttcaaaaggacaagagatgct

SEQ ID NO: 1686 - DNA, 398 bp, Nicotiana tabacum
cacaaaacaaacctcagtcttcttcttcttctgagtccggaactgaagatgggtcaggatccgattccgattccgattcgggtcaatcccaaccttccccttctgcttccgacttcaccgtcaagcccagtatatccgctgcaaaatccccatcaaaaccacttccaagaggcctcaagaaacccaacaacaacaggcccaaaaagaaaaacaatcaaggcccaataaaaagcccaagatttctgaagaagatagtaaggtttctgaggagaagaaatcagctgctactacacctagcaggctatggagtgatgaagatcagcttgctatacctcaaaggtatggctgaattcaaagcccaaaaaggttctgaaccaaatgcaactgatatgtctgct

SEQ ID NO: 1687 - DNA, 312 bp, Nicotiana tabacum
ttttaatggaaaaaacttgcaaagtagaaggtatttcacgctcataacatgctgaaatgaagggaaaataccaatactaaggaactgaaatagcgtatttcttttttatacacaaattttcagaagggaatattctactttgagaaatagccctcagtccgtcccttgaatccaatttgtccaaaagttaggcagatgaacaagcccaagtgccagcacaccaaccatagccagaactgagaagtgagagcaggtccagtggggaaatgagagagttcagtgccaatgctatcaaagaaaagcccactcaaa

SEQ ID NO: 1688 - DNA, 271 bp, Nicotiana tabacum
cttaagcttaggtcttggcctaaacaaagtggcaggaaaggttttcagaataggacatcttggcaacttgaatgagttgcaactattgggatgtcttgctggagtggaaatggtacttaaggatgttggttatccagtgaagtttggtagtggagttgcagctgctagtactttcctccaaaattccactccccttatcccatccagaatttaattcaattattataagtatacaaaaccaatgcttgtaattatttcttttcatgtcact

SEQ ID NO: 1689 - DNA, 216 bp, Nicotiana tabacum
gtcactgtacgtattgccagaagactcactcacaacgtccaaggactcacaagccttcagagagttggaattggactagtactctccgttgctggtatggtacgcttcagctttggtagaacgactaaggagggaccgtgccatccatgacaacttcaaaataagatgctttttggttagtccctccaattcttcattgtaggtgccggggaagct

SEQ ID NO: 1690 - DNA, 286 bp, Nicotiana tabacum
ttttaacaacaagaatagtagtaatattcattcacagtagaagacaacaacttcattattaacaacgtaaccatcatgtacatcaaacaaggatatggaattagggtcacttctttgaagcatgctctcctaccttctgctcgaaaaggcttccatcatagactgctcttacggtttctttcgtcagtatgccatccttggtttttgcctaaatcatataaagaattccaatctacagaagcatttgcccatccgaagtagtcctttgggttctcttttagccttg

SEQ ID NO: 1691 - DNA, 119 bp, Nicotiana tabacum
gagagagagagagagaggggataattgaaagtttaaaagtagtccaaaaatggaaggtgaaaaggaaaggattaaaatggcaagtgataagtacaggaaattcctgcatgaagaacaag

SEQ ID NO: 1692 - DNA, 417 bp, Nicotiana tabacum
gtttcatagtgtgcacccaatggctgaataccatggagcagcgcgggctgttggaggctgtgctatttatgtcagtgacaagcctggacagcacgattttaatcttttaaagaagcttgttcttccagatggttccatattacgcgccaaacttcctggaaggccaactagagactgcttgttttctgatccagcaagagatgggataagtctattgaagatttggaatctgaatgatttcaatggagtagttggtgtgtttaactgtcaaggagctgggtggtgtaaggtcggcaagaagaatctaatccacgattatcaaccagagacgataactgggattgtccgtgctaatgatgtcgactacttacctaggattgctcatgatggatggactggggatgccattctctaatt

SEQ ID NO: 1693 - DNA, 352 bp, Nicotiana tabacum
ttcaagcagctcgtgaaggcatcgttcttctcaaaaacgttgggcgggctctgccactgtccccacaacgccaccggaccgttgctgttattggacccaattcagatgctactgttaccatgattggcaattatgctggtgttccatgtggctatatttctccattacaaggaatagcaagatatgcaaggacagttcaccagcgtggatgcatgggggtggcttgtccagggaaccaacaatttggagtagcggaagtggcagtgaggcatgccgacgccactgtcttggtgatggggcttgatcaaaccatcgaagccgaagctagggaccgagttagccttcttctgcc

SEQ ID NO: 1694 - DNA, 462 bp, Nicotiana tabacum
atgaaatgaagatcagagatgataaagtagaaaaggaaatggaagcagctgtagtggatggaaatggaaaagaaaaaggccacatcattgtaacaactattggggggaaaaatggcgagcctaagcagaccattagttacatggccgagcgtgtcgttggacagggttcctttggaattgtgttccaggccaaatgtcttgaaactggagaaactgtggcaataaaaaaggttttacaggataagagatacaagaatcgggaattgcaaacaatacgccttcttgatcatcctaatgttgtttcactgaggcattgcttcttttcaaccacagaaaaggatgagctttatctaaatttggttcttgaatatgtacctgagactgtataccgtgtgttgagacattacagcaaagcaacccaaaggatgcctatgatttatgtcaagctctatacatatcaga

SEQ ID NO: 1695 - DNA, 445 bp, Nicotiana tabacum
ttttacatggcttttgatattttatataatcacccggagacattttcgctaacaaactaagaaaaataacgaggcttattaagcctttaggctgcagagctccctacattttcacgcttatataatgaaatatttcatgaatgcacaacatctgcatgctaccgtatgttttcagttacctgtatatgactagcaggattgagctgagaaattttgagaacaaaaaagaaaaaggaagagaaagaaaagacgacgataactaactaatcttaaaagaacagtgactgactaatttttcaaccaacaaatatcttctatgactcaacgatagctgcggtaagcggggctgtacatacagctctctgcatatgctactaggttcgcaggttccggtagacgagtggccaaacctagttcatatgctttagctgccactttggcagct

SEQ ID NO: 1696 - DNA, 481 bp, Nicotiana tabacum
ttttagaaaggatgtaattcgaccatttcaaattaaccatgtctttgttaccagaagcaacaaaaaggacaaaacaaccgagaaggctaattaattgtcacatttgattgatatttgaacgtgcactaattacaatcttttacctcattgtttcagtccccagcaaacactgtttatatctcgatatattaacaaggatcttctatatgctaccacatccggcatgcggctcgccaaatctcgtgggatacgcccacagcttgaagagtgagccatcaactgagtcatctgaatcactatcactatctgaggaaggtatggattcctctattacgtagtccacaatctgtttaattgacacaggcatgatctgatgttcatcagaaattttcccaaagcattcattggaacacttggaattactcagccaaacaattgaattgcactgcttgcaaaagcccctctgggatgttatctttct

SEQ ID NO: 1697 - DNA, 274 bp, Nicotiana tabacum
cgcgatcccatagatcacaatcacacaattcacacattaactttattcatagcccctggtccctgcgtcgcaaagggattcaacaaaacagaccataaaattacatagtatcgactaaaagtccgtttccaaaagacctctggtttccgcaatcaagattgtcaccaggactaacaccaagaatactgcaatacctcctgtaaaacccaatgcgatcctggacccttgagtcagtgccacgaccacattccaagccaccattgatgatgttcgt

SEQ ID NO: 1698 - DNA, 354 bp, Nicotiana tabacum
ttttacaaatacaaatgcaacctaaatgtttttagctccgaataatggttctcaacaacagtctaattctgtttgcttttgctctttcttcttctacaggggagcaattaactcaacctgcaggcaatggtacaaatatcaactatattcagacacaaatcctttccaacacgacacatggagacaaccgaatctggaagggtaaaaaattactaagttataacatgcaccgccgtcagaggaaacctccatcagtccatttggaatctgattttccaccatgaatggcatgtttggtaccggatgcactctggtagtgattatcaaatccatcatcctgaccatcatcccatc

SEQ ID NO: 1699 - DNA, 355 bp, Nicotiana tabacum
cctcgtgccgagaaaatgagtggcgcatcaccaaatgaaggacgtgccgttcgtcctgctactggaatctccatatctgattcaaggagtaatagaagttcggattttggtgcgggtaatcgtgctctatcagttaggacccgcaggtcaatgaatgtgaatactaggttgcgggattctttacaggagtcattgcagaccagccaaaatttacctcagcctgaaactccaactctagataatcctagttcgtccagtcaatttttcacagattcttcatcaagtgaatttagtgcttatagtttacctagaaacgacgatgacgatgatgatgatgagttacctggtgtagtgc

SEQ ID NO: 1700 - DNA, 318 bp, Nicotiana tabacum
ttttcacattcggacttgaaattaaaaaggatagaagtaagacgccaggtgttcgattgaataaaataactaacaaattgcgaataacatgtaagcacacttgcaattgtcaagcagtaaaattctgcttatagtgttagtttgcataataaagattcccaactcctttactagtaatctacctcctaccacagatagcaacattcctgacaatgtcatggtttttaccaggggagagtaggccctgttaatttcttgaagcatacccaattactgctgtgcacattggactctctgtgcaccaccaggcatatcatc

SEQ ID NO: 1701 - DNA, 387 bp, Nicotiana tabacum
tctgataccaacataacatgtaagaatgctaagatcagcttcagcctaataactaattatgctgtccgggccacgggccatgggcttcatacacttggggtgtacctcataaccacactcaaggcattggtaagcccatccataaccctgctcatcacaatcacaacagataaaagctccacgcccatgtccttctggtactaaagtaagttcgtggcgatggcccgaatggtgttctgtcttaggaaggccttttgctacttcatccatttgcttctctagtattcctactcttgtctttgtgaaagggtaagcattctctttatacaagttgataaggctcctaccttgtttggtcactgttttgccgtcagggcccaaaaccaa

SEQ ID NO: 1702 - DNA, 496 bp, Nicotiana tabacum
cctcgtgccctcctcaaagatttctcgtatctcttttcattgattaattttcagctttttattcattcaatcttctgtcataaaattgtaataaaaaagattaatttggaaaatataatggctgggatgtgttgtggtgttaatttaactgaaacagaagctacaactccagttgagccaagttcagaagctgcaagacgacgtcgtatggagattcatcagttccgtttagctccaccgttggaaaacggaacgaaacgacacaaagtggagaaagttgtagatcaaagcaagagacggaagttggaaactagtgtgacgatttcattgatgtctccgttgggtgtaacggagaaggtagcagagaaagaatttgacgctaaacctttggatctgtcggaatctgatgtttcgtctgttaaagttgatggtgttgaggttgttgctggtgataataatctgtctaagtttggtataacttctgtatgtggaagac

SEQ ID NO: 1703 - DNA, 491 bp, Nicotiana tabacum
ctaatacctgcacctgttcttaagaaaagaagctcgtgcttgaatgggaaaaaacataataaatatagcaattgtaattgcttaactgcagaacagtcattgttgctcgagtgcaaagactcaaccgaatgtaagactttaactatgagtgagaaagctctgcactcaagcaaggttgcacaatgcaccaccggtaaagggatcgcaagtttccctatagatgcttcagatttggccaactttctaacaatggacaggcatataggatttaattgcaatgcaccagatcttataaagtcggtactcgcggagaaacaagaactatgtttttctgttatctcattgctgtggcacaagttaattgcatcacctgaaacacaaccgagtgcagaaagcacttccgctcagcagggatggagacaggtcgttgacgcactatgcaacgtcgtatcagcattgcctgcaaaagctgcaacagccattgttcttca

SEQ ID NO: 1704 - DNA, 546 bp, Nicotiana tabacum
caagtcttcccatcatgtctacctcacataaacataatactcctcaaatggctgctatcacactcctaggattactacttgttgccagcagcattgacatagcaggggctcaatcgataggtgtttgctatggaatgttaggcaacaacttgccaaatcattgggaagttatacagctctacaagtcaagaaacataggaagactgaggctttatgatccaaatcatggagctttacaagcattaaaaggctcaaatattgaagttatgttaggacttcccaattcagatgtgaagcacattgcttccggaatggaacatgcaagatggtgggtacagaaaaatgttaaagatttctggccagatgttaagattaagtatattgctgttgggaatgaaatcagccctgtcactggcacatcttacctaacctcatttcttactcctgctatggtaaatatttacaaagcaattggtgaagctggtttgggaaacaacatcaaggtctcaacttctgtagacatgaccttgaattggaaactcttat

SEQ ID NO: 1705 - DNA, 413 bp, Nicotiana tabacum
ttttaagaagaagctgaaattttattattagtttcaacaactattacattcagcttgaaaaggcccttagtaaggtaacctttttcctacaaacatttcattcttactaatcactaccttgtcagatacaaaaacgcacttgaaaccatgctttacaagaagtccagtaaagactaagttcttcctaatctcgggaacatgaaggacgttgttcaaagtcatgaccttgccagaagtcatcttgagaaatatcttaccgtatccttcaatgtttgttgtagcagcatttcccatagagagcttctcttcgggtccagcagaagcatatatagaaaatacttccctcacggcacaaacatggtgagtggctccagaatcaatccaccactcctttgggtttcctaccaggttgc

SEQ ID NO: 1706 - DNA, 419 bp, Nicotiana tabacum
catagaagaagaggagagagatagctgattctattcatgttctgcaattgagaattttatacaaaaattaagattatgagatctgtaattgctcctaacaagtggaactagctaacggatgaacttaagttagctgaaattgacgccaaatgaaatacaagccaaatttttgtgcctcagtaattttatataaagtatgatttgcagtacttattttacagtaaaggtgctgactgctgatcgtgctggctgcgcctttctggtcaaggaatcggaaatatttaaagggatagaaagtgaagatcctctaattggtgccgtcaagccaaagaaatgaattgatacagaggagtatatactacggagttctgccgataaatcgagtcccatggcctataataacgtggaggatactggga

SEQ ID NO: 1707 - DNA, 453 bp, Nicotiana tabacum
tttttattcaaacttccatgcattagcttaaaaaagatgacattattacatgcagatatatttctcctataccgactaaaatcttacttctcatcgagtttgcacataggtaggatcatacatggcaaaagttacaaggtaatactcatatttaggggacagtaggatgtaattcgcgacacgcattgcaaacttataatgtgggaggaatccatatatagccatgagtttgaacgtaaccgacattttgcagcaactcatctgcttcagcaggacctctgctgcccggcttgtatggaattggcttgatctctccatcgtcaattctatgcaaaagtggggtaaaaatctcccaagcggccttgagctcatctctgcgcacaaaatgctgctgatcccctcttattgtgtcgagaatcagacgttcataagcctctggaatgacaacccctt

SEQ ID NO: 1708 - DNA, 476 bp, Nicotiana tabacum
attaaggaatcaatatgacaatctgaaatcagattacaataatctcctcaaggaaaaggaaaatcttagagctgaggttttccagctcaacgataagctgcttctcaatgagaaagaaaatgggcaattgactcaacgcgacttccagaaacactccgattcatcgccaaaagaaaccatggctgatcctatttcaagggttaaaatgtccaatgtgtcagctcgggttcttaaggaagatctaagctctgctaagagtgatgtcttaggatcagaaagcccacattacactgatggggtgcattcctctttcgtaaagcaaggtgattcttatgtagttgaacctgaaccgtcagatttatctcaagatgatgaagagaacttcaacaagacaatgctctctactgccaacttgcttgcaaaagccgaggatgatgattatcgcgtgacatcctcaaatgtgagctactttggat

SEQ ID NO: 1709 - DNA, 387 bp, Nicotiana tabacum
gcgatctactatgtttcactatactttgttttaatggcaatctatgttgccttgtagctttagttttttttttctttaattactttgatttcatgtgtttcccaaagttatggtagtttttgatctcctcagtgatgagcaaaacagatgacgagtctgattgaaatccattcaacttaaatcgtgaggacaatacgaggcatttgtctgagaggaactccctactacatttcacccctcttcttctttgctctgctaaattttttttccattcattaacttttaagtttttccttcaaattttagataattctggtgactattgctaaatatttatgtctctttgaggacagccggtaaaataaatctgcagattacatattaaaa

SEQ ID NO: 1710 - DNA, 397 bp, Nicotiana tabacum
gtactacacaacacaagtcacaaaggttaaaggatctccatttatgattgattgtacaggccaaccaattctaaaggacagaagtagggggttggttacctgggaaaggtgaaatgacgaggttgccacttgggtcgtcgccgattgacatcgccggtccgacgaccaactggtgggaccagatcaatgagtccgttcagtggcaagatgggattttttactctctttgtgcttcctatgctcttgtctcagccgttgcccttattcaattaataaggatcgaattgagggtacccgagtatggttggacaacacaaaaggttttccatctgatgaactttgttgtaaatggagttcgtgcaattgtctttggatttcacaaacaagtgtttctctt

SEQ ID NO: 1711 - DNA, 441 bp, Nicotiana tabacum
aagtctagattccaagatcacaggaacaggaaacttaggatgtgtagtgagcccataatgttcttccacacttatatcttctggcttcataccttcaggtaatttccagttgaatccatgcaacatgttggctaatgttactcggataaccttaagtccaaggctatagccagggcacctccttcgccccgatgccaaatggcaagataagcaaagttatgtccgtccatatcaatgtcgttctctaaaaatctctcggggatgaaactcttgtgctctatcccagtattttgggtcccttcccaatggtccaaacattcaccagaaaggtcgttcctttctgtatgtcataaccagccacgttacaatcttctatagcacaatgcggtgctagcatagttcctagaggatgtaaccttagtgtttccttgaggattgctt

SEQ ID NO: 1712 - DNA, 427 bp, Nicotiana tabacum
gaatcaaattccgtccaattctcgccggtagatctctcaatattccggcgacttccgtctgcttttagtctccatgaatccagaatatgactacctgttcaagcttctgcttatcggtgattctggtgttgggaagtcatgtctccttttaagatttgctgatgacacatatcaggagagctacataagcacaattggagttgattttaaaatccggacagtggagcaagatgggaagaccattaagcttcagatttgggatactgctggacaagagcgttttaggactatcactagcagctactatcgtggagcccatggcataataattactctagtggtgtgaatcactagtgaattccgcggccgcctgcaggtccgaccatatgggagagctcccaacgcgttggatgcatagcttgagtat

SEQ ID NO: 1713 - DNA, 216 bp, Nicotiana tabacum
gtcagatccgtactcacacgttaaacctcagatatttgcctttgctcgtcattgatgacgacttcattttgttttcttccccacgaaaatggtagatatgatatggagggacgtagggaagaattactgggacaaacctagtgagtgaaaatggaaacagttgaaatgatagtaaaagtatcttgtgctgccataataattactctagtggtgtga

SEQ ID NO: 1714 - DNA, 204 bp, Nicotiana tabacum
gcaaataagatagatatgttccgttaatcttaatcacatagagcaactgtaacacaatttgcttgcaacacttttcacgtagaagactgctaaatacaaactgaacagagagagatcaacttgagaagaaaaacactgccctttcaagtcctgatcacagtaacagcatcttgtgctgccataataattactctagtggtgtga

SEQ ID NO: 1715 - DNA, 293 bp, Nicotiana tabacum
aatttacttgcgtgatcatatcgtccacccaatcatagatcagcgccatgatgcagaaggactccaacctgtaaatgatgactacgagcagttaatcgagcgtatgttagagcacgacacaattatctttgctacaccgctatactggtatggaatgagcggtcatatgaaaaacttcgtcgatcgctggtcacaaagcttacgtgatacatctcttcatttcaaagaaaaaatgaaagggaaaaaaatgtacgttgtcatcgttggcggagacaatccaaagctgaaagcat

SEQ ID NO: 1716 - DNA, 486 bp, Nicotiana tabacum
taattgaaattggtgacaggacgaagattacggcaggctgtaaattcatcaaccatgatggtgcaatgtacgtgatccgaagcatggaaaagtatgaagatgcccggaattttggcagaataaaactcggaaagaattgttttgtaggaaataactgtatttttcttcccggctcacaaatgggcgatcaattgtattttgggcgcaggatctgtactgaattccagtatgcccaataattccgtttatgcgggaacccctgcaaaattcatttgtactgttgaagaatacggcgataaagctttggaaaataatgtaatgtaccccagagaactggaacccgacagagcaaagcttgaagcatatattaaagaacacatccctcatgtttacaaacccgtaaaaaaataaatggctgaaaaaaagaaaatcctcattcgtataggctcactgcgacacggcggcgcggagaaagttctggtgaca

SEQ ID NO: 1717 - DNA, 470 bp, Nicotiana tabacum
ttaaaggtctgttcgccgtgggtgaatgttcctctgttggtctgcacggtgcaaaccgtctgggttctaactccctggcggaactggtggtcttcggccgtctggccggtgaacaagcgacagagcgtgcagcaactgccggtaatggcaacgaagcggcaattgaagcgcaggcagctggcgttgaacaacgtctgaaagaactggttaaccaggatggcggcgaaaactgggcgaagatccgtgacgaaatgggcctggctatggaagaaggctgcggtatctaccgtacgccggaactgatgcagaaaaccatcgacaagctggcagagctgcaggaacgcttcaagcgcgtgcgcatcaccgacacttccagcgtgttcaacaccgacctgctctacaccattgaactgggccacggtctgaacgttgctgaatgtatggcgcactccgcaatggcacgtaaagag

SEQ ID NO: 1718 - DNA, 480 bp, Nicotiana tabacum
tgaagattcggattgatacattttgcccaaatctgaaatgtggaaagccattttccactttctctgtaaaaatctttctgaagagtagaatagtgatctgccatataacaaaggtagtaaatcttgtattttaagttgaatttaattataatccgtctaaaattgaagtaattttgttcacggaattttcaagattgaaaggcatttcataatctttcagcttctccgaatatttatcaaaaaattcaggttgagataatgcttttttcattccgtcataaattccttcatccgagttttcaacaattaaccccaattctccattattcagcatttcgttcgctccggaaacttcagtggaaataattttctttttcagggtgattgcttcaaagagaacggttgggaatccttcatatcttgagcttataaatataaaaatccgcttttttgaagtatggataaggattatctgtaaaa

SEQ ID NO: 1719 - DNA, 521 bp, Nicotiana tabacum
aatgaagattcggattgatacattttgcccaaatctgaaatgtggaaagccattttccactttctctgtgaaaatctttctgaagagtagaatagtgatctgccatataacaaaggtagtaaatcttgtattttaagttgaatttaattataatccgtctaaaattaagtaattttgttcacggaattttcaagattgaaaggcatttcataatctttcagcttctccgaatatttatcaaaaaattcaggttgagataatgcttttttcattccgtcataaattccttcatccgagttttcaacaattaaccccaattctccattattcagcatttcgttcgctccggaaacttcagtggaaataattttctttttcagggtgattgcttcaaagagaacggttgggaatccttcatatcttgagcttaaaatataaaaatccgcttttttgaagtatggataaagattatctgtaaaacccagcatggttgctgtttcatcaacaccaagatcggactt

SEQ ID NO: 1720 - DNA, 419 bp, Nicotiana tabacum
ttttagagaattttgctatcctataaaagtatgtatgttattacattctacttttactatgtgacttttacatgacatttaaaaaataccaaaaattaaccgaaccataccgataccaaagaaaaaccgatatgattgggacgatttcgaaaagtctaattttgattatacaaaatagaataaccgaaaaaatggtatagtacaaattttatgaaataatcggccgaaccgaacaattgacaccccttttagctccgcatcaggtggtacaacaaacttcttctcattaatattctgtaatttaccaagtctaaagctaccacaaccacctctcactcttttttttatcttccgggcaagtttaacttttattgcaacgactgttttcgtctttccttttttcttcacaaatggacatt

SEQ ID NO: 1721 - DNA, 399 bp, Nicotiana tabacum
tacgactcctcttctttagacaatccaaaatggttctccaaactgaaagctaccccgctcttggcttctagcagcaacaaagctactataacgggaacgacttctactcctctgaggacaaatataacagcaactacggctcaagcatgcaaatgacaaagccttatggttatcccagcgtaaccactcctcagcacacccaacatcacatgatgataagccaaggcggctatagccacgacgatgatagctggtacaacaaagacaagtaccaaagtggctatggccaccacaatagccatggccaatatgggcacatgtcccatgattcctcaaacttttacagcgataatagtggctatggaagtggaatgcagcactctagttcacacatcgacg

SEQ ID NO: 1722 - DNA, 401 bp, Nicotiana tabacum
ctttaataaatattctatagtttgtccgttgaaatccataactaagattgtagatacgtaaattccttaattctctcccataataagaacaaacgttcagtccatttggaactttgtcccttcttgggtctatctggcatcttcgagcagaaccatttgaagaaaccaaggcaacatttgcaacaagtgaatcttccttttgctacttcagtttttgagacagatatctgggtctaattcaagtttgttcgtttatgaattaattatgggatgacaaatttggacagctaaaagtgactgttgtaaaaggcaggcgtttggtgattcgggacttcaacagcagtgatccttatgtcattctcaagctgggtaatcagtggcgttttattctccatgaatca

SEQ ID NO: 1723 - DNA, 190 bp, Nicotiana tabacum
gtgagtgtgtgaagtgcaaagccgccgcgttcgagaactgggtgtccggcatttggttgaatggctggccagatagtgtaaggacagttgttaactagggttagaattaaaccagagtaagtggcttgagagagagcacaaagggttaaaaagagagagagtgaaagtaaagtttttgtagatgaagaag

SEQ ID NO: 1724 - DNA, 236 bp, Nicotiana tabacum
gaatattaaacagtgtcttgtcttttcttttacaacatggctgtcaaaaataaggttagtaatggcaatctgaaaggaggaaatgtgaaaacagatggagttaaggaggttcactacagaggtgtaaggaagatggccatggggtcggtatgcagctgaaatccgtgacccgggtaagaagagtcgggtctggttaggtactttcgacacggcggaagaggcggctaaggcgtacg

SEQ ID NO: 1725 - DNA, 232 bp, Nicotiana tabacum
ttttcccatcaaatattaatgtatttccagtattgtaacttcacaatgccgtactgatatgtaagatatgtaaatgctagctactgcttaatgacaaaaatggccgcgaaagaggattggggtatgtttgtcacatttcacgtgtgagcttgctgcggctgctcctgaacaataagaaaatagaaattggaaaaactaaactctgaagtttcaaccaccactaacctcacac

SEQ ID NO: 1726 - DNA, 313 bp, Nicotiana tabacum
gggactatggagtcgctgatggcaacattttgcatttggttcttcgtctgtctgatttacaagcaattactgttaggacagtgtgtggtcaggagtttgagttccatgtggagagaaagagaaatgttggttatgtgaaacagcagattgcaaagaaggggaaggggttttgcaatctaaaggagcaggaactaatatttgatggtgaagaataagaagataagaggctgatagatgatatttgtaaaagctacgatgcggttcttcactttgctggtgcgtaaatcagctaaagtacaggctagagcagtgc

SEQ ID NO: 1727 - DNA, 447 bp, Nicotiana tabacum
attttatcagggtcacaagaatactagcagcttgcatccagtgttcaaaggtcaaagcttggttctattgggagacagagagaaatccaattacaataatgagaagaatttaggagtttatgagatggaagtgaagctttacatgcgtatcaggctaaaggctggttggatcaaaacacacaaaattaagccaaagattgagtgtgatttcaaggttcctctggagtctaatggcagatcatcatctgctaatttcgaggaaactagatgccatcttgattggtagttttcttctatcatcgcaccattattgatcgtcttcacacttcgcctcctttgccgcgaatcactagtgaattcgcggccgcctgcaggtcgaccatatgggagagctcccaacgcgttggatgcatagcttgagtattctatagtgtcacctaaatagct

SEQ ID NO: 1728 - DNA, 354 bp, Nicotiana tabacum
gcttgttgatgcaatatcgaggcgatattccccttgtcagcgatccggcctaccatcatttttggtgcggatgtcacccaccctcaccctggggatggattctagcccatccattgccgcggtggttgcttctcgagattggcctgagattacaaagtatgctggtctagtttctgctcaagcccataggcaagatgcttattcaggatctgtacacgatctaggcaagatcctgttaaggggacagtggctggtggcatgattaaggacttacttatatccttccgaagatgctactggacaaaagcctcagagaatcattttctacagggatggcgtagtgaaggacaattt

SEQ ID NO: 1729 - DNA, 326 bp, Nicotiana tabacum
caaagctattgaggtctttaaaaatgtcagaaaacctcaagaaaacaacattaaagagtaggcatataataaaccaaaacttaagcaagtatgcccaacagcttccagaaaagaagcactaaatccagacattgtcctaaaagtaaattgtttaggcaactcaattgcaataaggaaaaagatatgtcgcagcaaaataacaagatagtcaataactttagctatacaagtcatcatcatcagctccagcattagaagttgcaaaggggtcagttgcatcagccccaccacttgcctcagcaaaccgaaattcagttccaaaacct

SEQ ID NO: 1730 - DNA, 347 bp, Nicotiana tabacum
gcacaaccctacacccaatactaaattttggaaagtgggttgcatttttgtattccgtgattccttttatctcttcctctttttctcctttttcttcttcctttaggtatatacccatatatagcctataaaccatatagctatataaaaactctacatctattttgagaatttgatgatttgggtcggctaaaaatacaatcttcttaatacccttcccgaaatcttggcacaaatttgtgagatggagacgcagaacctggaacgtggacatgtaattgaggtacgttgtgacatggcagctcaagaaaaggggactaaaatctgtggttcagcaccgtgtggat

SEQ ID NO: 1731 - DNA, 323 bp, Nicotiana tabacum
gcacaaccctacacccaatactaaattttggaaagtgggttgcatttttgtattccgtgattccttttatctcttcctctttttctcctttttcttcttcctttaggtatatacccatatatagcctataaaccatatagctatataaaaactctacatctattttgagaatttgatgatttgggtcggctaaaaatacaatcttcttaatacccttttgaaatcttggcacaaatttgtgagatggagacgcagaacctggaacgtggacatgtaattgaggtacgttgtgacatggcagctcaagaaaaggggacaaaatc

SEQ ID NO: 1732 - DNA, 373 bp, Nicotiana tabacum
cttcaaccaagttgttatatttgtcaagagtgtaaatcgggcagcacagctggataaattactagtggagtgtaattttccatctatctgcatccactctggcatgacgcaggaagaaagattgactcgctacaagggtttcaaggagggtcacaagagaattcttgtcgcaactgatctggttggtaggggcattgacatcgaaagggtcaacattgttattaactatgacatgccagattctgcagacacttatcttcacagagtgggtcgagctggtaggtttggaactaaaggccttgccatcacatttgtgtcatctgcatccagattctgatgttctaaatcaggttcaagaaaggtttgaagtaga

SEQ ID NO: 1733 - DNA, 403 bp, Nicotiana tabacum
gctctctttatacactgctctgggaggcattcgtccgtcagcttgcttgcccattaccattgatgtgggtacaaacaacgaggatttgttgaacgatgaattttacattggactcaggcaaagaagagctagaggacaggaatatgccgaactttttgatgaatttatgtatgctgtcaagcagaattatggggagaaagtgctcattcagtttgaagactttgcaaatcataatgcatttgacctccttgcaaaatacggaactagccaccttgttttcaatgatgacatacagggaacggcatctgtggtcctcgcagggctcatggcatcatttgcaattggttggaggaaccttggctgaacatacattcttattccttggagcaggggaggctggaac

SEQ ID NO: 1734 - DNA, 332 bp, Nicotiana tabacum
cttgttccttattatcttgatgaacaaacaggatgggggcttgagatctcagaacttgagcaacagctgaaaactgcaaaatccaagggtattgatgttagggctttggttgtgatcaatccaggcaaccctactgggcaggttcttggtgaggccaatcaacgggaaattgtagagttctgcaagagggaaggccttgtccttctggctgatgaagtctatcaagataaatgtttacgtgcctgacaagaaattccactcatttaaaaaaatttcccgctctatgggatatggtgaaaaggatatatctttagtgtctttccagtccgtgt

SEQ ID NO: 1735 - DNA, 346 bp, Nicotiana tabacum
ctgaaattgaagattattttgttgattcacctcctgttattgacgatgacagccggaagttaccaaaacttgacgatgacaacagcagactacattcgaactggtttaactccaagatggagtgacttagatgttaaccagcatgttaataatgtcaagtacattggctggattcttgagagtgcacccatgcaaatactggaaggctgcgagctcgcggccatgacattggagtaccgaagggaatgccagaagggacagtgtgctgcagtcactgaccctctgtactggacaagggtgtcggtgacttggatgacattgggaatgttcagtgtcaacatttgct

SEQ ID NO: 1736 - DNA, 410 bp, Nicotiana tabacum
ctttaactctgaagaagcaactttcatttatttaggaagaatacaaattgaaagaacactaacaaggaaaaagaaaaaaaaaacagaggttgcacaatcatctctggctgaaggcgcaccgccacttctaatccaccgcaagcaccatgtaaccaaaagccaacaaggattacacaagctctaggacaagggccgaggcacctcctccgccattgcaaacaccagcagcgccatatttgccgtttttctgtctcaataccccaagaagtgtaaccaatatacgagctccactgcatccaagagggtgccccaaagatacagctccaccatgtacattaactttttctggattaagaccaagcagcttttgatttgcaagagataccacagcaaaagcttcattaatttca

SEQ ID NO: 1737 - DNA, 328 bp, Nicotiana tabacum
tacagatcgcacgttctgtttgtcaactactatcagtagataatctcaacaggaatatatacatcactggatggattttccttccattaaaaatgtgaattatttatgtaaaagaaattctacgcagttaaatggccgttttaggatgttgtagtgcaatctatgtctaccaagctcttcaaaggctaaagaaatttttatgtctcaactgtcttcaactttgcagctgctcggatgagggtggctgcaaatgaaaaggcagaggctgagaagattttacaaattaaaagggctgaaggagaggcagagtcaatgtatctctcagggt

SEQ ID NO: 1738 - DNA, 388 bp, Nicotiana tabacum
gatttgggctgattatgggcctcattatgttaaagtaaggaagctctgtaatcttgagctttttactcctaaaagacttgaagctcttagacctattagagaagacgaagttactgccatggttgaaaacattttcaaggattgtactaagcctgataacacaggtaaaagcctgttgatgagggagtacttgggatcagtagcattcaacaacattacaaggttaacatttggtaaaaggttcatgaactcaaaaggtgagattgatgatacaaggtcaggaatttaagggcattgtctctaatggcatcaaaattggcggaaagcttcccttggcagagtatgttccatggctccgttggttttttcacaatggaaaacgaggcac

SEQ ID NO: 1739 - DNA, 432 bp, Nicotiana tabacum
ctggaattgccatgcacaagaaaaacgaactttgccttgtcccaaaaaattatttataaattatattgggacgtggatctcatgctagttctgtgcggtcagctaagcttaaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggt

SEQ ID NO: 1740 - DNA, 470 bp, Nicotiana tabacum
ctttctttctccatcgctataagtaaaaggttcaattttgggatttcagggtttgctattggacaatctttgaggaggagctagattaagaggcttttgtgaagatgtgggcagcttcttgccttgcgtcatgctgcgcggcgtgcgcttgtgacgcttgtcgtacggtagtgtcagggatcagccgtcgttccgccaggattgcctattgtggtcttttcgctttgtcactcattgtctcgtggattcttagagaggttgctgctcctttaatggagaaaataccatggattaatagctttgattcgacaccgaacagagagtggtttgagacagatgctgtgcttcgggttagtctggggaacttcctatttttcactatcttagcaatcttaatgattggtgtgaagaaccagaaagacccgcgtgacagcatgcaccatggaggttggatgatgaaaatcatttgg

SEQ ID NO: 1741 - DNA, 489 bp, Nicotiana tabacum
attgaccctatttacagactttgttgctgtctttgtgcgtattctgatcatcatgctgaagaatgcatctgagaaggaagaagagaagaagaaaaggaggagagactagattgtcatagcttctttaaagaaactatgacaaactctgtgatatgggatctgctttttcatttacttctgtttatctcgacaaacatgttaatagtttggtactagctttagcttagattgtgatacagtgttgtgtggcttgccgcgatggctgcgatggaaacatgtggctatgttttggaattttgacatctgataacaaaagtaattgtgataagcctagaatcactagtgaattcgcggccgcctgcaggtcgaccatatgggagagctcccaacgcgttggatgcatagcttgagtattctatagtgtcacctaaatagcttggcgtaatcatggtcatagcctgtttcctgtgtgaaattgttatccgctca

SEQ ID NO: 1742 - DNA, 541 bp, Nicotiana tabacum
  modified_base (493)..(493): a, c, g or t
ctcttgcaaatttatgcatgaccgtggagattataagtctggttggcagattgaaaaagagtgggacgaagctgagaaagagaggaaacgtaaattggctatggggatgctcgacgaggatgatgaggatgctgagaagagtgatgatgatgatgatgacgccttaccatttgcttgctttatctgcagagagccttttgttgaccccgttatgaccaaatgcaagcattacttctgtgagcattgtgcattaaagcaccatgcaaagaacaagaagtgttttgtatgcaaccagcccacttgtccagcttcaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggangcataaagtgtaaagcctggggtgcctaatgagtgagctaactcacat

SEQ ID NO: 1743 - DNA, 207 bp, Nicotiana tabacum
cctcgtgccgaattcggcacgagggtagctcatgtagtgaaaacaagaaatacggcaaatacttgtcttagataataacacccgtcaaaaagttttgatcgttccatttctttgtaaaatattgttttctactagtatctatcattgtaaacttcaacaagcaaacatggtagtcttgtccaaaccagccccacttgtccagcttca

SEQ ID NO: 1744 - DNA, 461 bp, Nicotiana tabacum
ccacgatatgcatcgactatcactgctaattacactgaaccaaattaagagcatctgagagcagctgattaattacgttaaattattaattcatggtgctacttagcatccaaactctttcctcttcatacccaactctcaataattacacctttaattatcgctctcagcgacaaagccagagccaaaaccagaaccagaaccagaaccagaaccagagacgatgtgtgaaaattcgtagtaatgttatccgatgtgggatagcggaaccatcaggggaaccagccccacttgtccagcttcaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaat

SEQ ID NO: 1745 - DNA, 233 bp, Nicotiana tabacum
accatctgggacaacaccgtttgactcaaaccctgctcagccaaaagattttgatcctactggatgggaacttgccctggtcactactcctagcagcgacttatctgcagctcaggagagacaattggctggtggattggactccctcacgctcaatagtttgtatgatgtaggagcatatagagcatctcaacaaccagtatatggacaaccagccccacttgtccagcttc

SEQ ID NO: 1746 - DNA, 282 bp, Nicotiana tabacum
tggtgaagtcgaaatgaggttgatggaaatcaataacggcacttggaaatcaggcatcatcgttaagggcttcgacattcgtcctaactaattggatagatctctacccagtggcctttatgttttctgttttgcatctttgttgtgtttgtctttatcattttctaataaaatcactctttctctatgaaaagagtgagcttgttgtaagtgcatgtgatattatttatgatccatctttattaccttattctgaattataataaaatattttacgatttc

SEQ ID NO: 1747 - DNA, 498 bp, Nicotiana tabacum
ctgaactatagatctgggattcggagcaacttttgaagaagaagaaacttaggttaatcactgaaaaagcagaaaaaaatgtcgtggcaaacatatgtagatgatcacttgctgtgtgagattgaaggtaaccatctcacatctgctgctattattggtcaagacggcaccgtttgggctcaatccgccaattttcctcagttcaagccagaagaaataacaggcataatgaaagactttgttgaaccagccccacttgtccagcttcaatcactagtgaatacgcggccgcctgcaggtcgaccatatgggagagctcccaacgcgttggatgcatagcttgagtattctatagtgtcacctaaatagcttggcgtaatcatggtcatagctgtttcctgtgtgaaatcgttatccgctcacaattccacacaacatacgagccggaagcataaagtgtaaagcctggggtgcctaatgagtgagctaactcacata

SEQ ID NO: 1748 - DNA, 271 bp, Nicotiana tabacum
tgaaaaatcttgatttacataatgtttcaacccgtcatggcgatggatggcaaggttggcaggcacgtgcgccgtttgacgctatcattgttacggcggcaccgccggaaattccaactgcgctaatgacgcagctggacgataggcgggattctcgtcttacccgtaggggaggagcaccagtatttgaaacgggtgcgtcgtcggggaggcgaatttattatcgataccgtggaggccgtgcgctttgtccctttagtgagggttaatt

SEQ ID NO: 1749 - DNA, 226 bp, Nicotiana tabacum
gcaaataagatagatatgttccattaatcttaatcacatagagcaactgtaacacaatttgcttgcaacacttttcacgtagaagactgctaaatacaaactgaacagagagagatcaacttgagaagaaaaacactgccctttcaagtcctgatcacagtaacagcatcttgtgctgccataataattactctagtggtgtgtatatggagagtgctgaattggg

SEQ ID NO: 1750 - DNA, 187 bp, Nicotiana tabacum
gggctttggttggagcgggggctcgtgctcttttttatcccacattgttgtataatgttgtgagaaacaagattgagaccgagtttcgatggtgggatagggttgatgagttcatactgttaggagctgttccatttcctgctgatgtccctcgcttgaaggctctagtggtgtgtatatggagagt

SEQ ID NO: 1751 - DNA, 293 bp, Nicotiana tabacum
gtcattcgtaacggttcacatcacaaatagtcccctttttgatagccagattccatggaaacaaaagttctgtccagcggaatccgccactctactatccctcaaagttatatccgccctcaatccgataggccacgcctctctgaagtcgttgattgcgaaaacgttccagtaattgacatgggctgtggagatagaaaccatataattcgtcaaattggcgaagcctgtcatctttatggttttttccaggtaattaatcatggtgtaccaacgaatttagtagaggaaat

SEQ ID NO: 1752 - DNA, 545 bp, Nicotiana tabacum
tcttcagagctgggacccgacgttaatcaatccttgcacatggtttcatgtcacctgcaacggcgaaaatactgttgtaagagtggacctaggtgctgctaatcttaccgggacactggtacctcagttgggaatgctagccaatcttcaatacttgcaacttgaaaataattcatttagcggagcaatcccaagccaattaggcaacttgacaaggctagtgagtttgggattagacaataacaagctgagtggccctatcccatcatctcttggcaatttaatatctttgcgatggatgagattgaacggtaataaattatcagggaaaattccaatctcagtcttgaagctcatctactggggaaatttgcagctactgaatgtttcagacaataaactagcagggactgtccatcgtgctaaccaaacaggatttgcaattacaacaattgttcaagacgtcaaggcctagatcaggttacttgatcaacgtttggaattggattgtcctgcaaagttgcatttctatattagactgtgtc

SEQ ID NO: 1753 - DNA, 594 bp, Nicotiana tabacum
ataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaac

SEQ ID NO: 1754 - DNA, 471 bp, Nicotiana tabacum
cgttcctttgtccgtgcgatagcgcgaaaatcagtgctccaaagctcctgactgaagatggatctccagtcatttatcaggactttacgtatgctgagtattacaagaagttctggagcaggaatttggaccaagaacattgtttggagtgtgcacaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggaga

SEQ ID NO: 1755 - DNA, 495 bp, Nicotiana tabacum
cttcttcaagacttacaagtagctggtcttcaagttcttaaagatggtaaatggttggctgtcaaacctcagccagatgcctttgtcattaatctcggtgatcaacttcaggcagtgagtaatggaagatacaaaagcgtatggcatcgagctattgtaaattctgataaagccaggttgtcagtggcttcgttcctttgtccgtgcgatagcgcgaaaatcagtgctccaaagctcctgactgaagatggatctccagtcatttatcaggactttacgtatgctgagtattacaagaagttctggagcaggaatttggaccaagaacattgtttggagtgtgcacaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttattt

SEQ ID NO: 1756 - DNA, 504 bp, Nicotiana tabacum
cttcttcaagacttacaagtagctggtcttcaagttcttaaagatggtaaatggttggctgtcaaacctcagccagatgcctttgtcattaatctcggtgatcaacttcaggcagtgagtaatggaagatacaaaagcgtatggcatcgagctattgtaaattctgataaagccaggttgtcagtggcttcgttcctttgtccgtgcgatagcgcgaaaatcagtgctccaaagctcctgactgaagatggatctccagtcatttatcaggactttacgtatgctgagtattacaagaagttctggagcaggaatttggaccaagaacattgtttggagtgtgcacaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaat

SEQ ID NO: 1757 - DNA, 471 bp, Nicotiana tabacum
gcaagagaagatgtccaacaatgctgctgatgagaaaagtagtgagcaatcgcagtcgcagtcgcagtcgcagtcgcagttgcagctgcagtcggaagggtacccaagagggcctctctcttaccctaagcccgaagctgagtaccaacaaattgttcaaaattcccaacttttctggaacaaacttcagcaattctctgcatcccttcctaccaatttccagatccctcttgtagcaggaacaccgctagatctacaccgtctttttattgaggttacgtctcgaggtggaatagaaaaggttattacagagcgaaaatggggggaggtgaaaggaatattcagatttccatcttctgtgaccagtgcatcatttgtcttgcggaagtactatctatccatgctttatcatttcgagcaggtttattactttcggaaagaagaaccttctgtctctgtggctgatcctac

SEQ ID NO: 1758 - DNA, 472 bp, Nicotiana tabacum
ataaattatgcactatggacagattttagcatcatgtattggtacaatgcactccgagtctgcaaaacaacagtatcagttgtttctcataaacgcaaagaatagaaaaaagacacctccacgtgtgttagaataggcatcatgttgagtactcaacgttgcatggaaactatggttcatagtcctgagcatctgcttcaccccttggactagcctgatcaacaccaaatgtcctcttgctcatgtttgctcgttgcactagcctaactaatgcttcagccacttccgacataggtggcctgaactcaggctcgggctggacacagagagctattacatcagcaaagcgtgatagggatttaacaagaatatggcctcagtctcttcaagccaatggcaaaagagtgcctaaattggttaaatcatcaaacaattagctcagtagtgtatgtatcatttggaagtatggcca

SEQ ID NO: 1759 - DNA, 479 bp, Nicotiana tabacum
ttttcagaggagactttgtgatgaaattatggaacgagtatccatagccaacagttacacactggtgatgatgcatccaggagtttctgccactacagttgcacatcttgcatagccttttgcaaatatacaagtatggaagctcataagagtataaaactacaagcttttcatgtcaaaatgtcacatttgattatacatgggaaaaagggatgcattacttaccttatttttccgtcaccacttcatctcttgatgacacagataactcaaccatttacagctacaattacactcacagagactgcagttagaggctcatcccttgttgcataaacaggcacatgttaccttcttgggcgggttactgatgattaattaaaggtattttccctgtgtacttaaggaattaccacactaatccctttcttctcctgaacctgtcaacacgatctgtgctcatccgagacttctcgggt

SEQ ID NO: 1760 - DNA, 535 bp, Nicotiana tabacum
gtttcctaggtacaagtatcattttcctttccttgaaactaatggactagtaactgtggacgacaaccgggttgggccactttacaaacacatttttccaccagcctttgctccaagtctttcatttgttgggctgccttggaaggttataccattccccttgtgtgaattgcaaagcaagtggatcgctggtgttttatctggtcgcatttctctcccatcaaaggaagatatgaatgctgatattgaggctttatactcatccatggaaacctcttgcattccaaaacggtacactcataatatggatgattgtcaggtataacatctgccaaaacttgtcgaatggttgaaggtttctatttctgttctctgtgtcgtcttcttttcctttccttttttacttcatatgcctattcttaacatacagaagttctaggctacaccaccttagttaatttggaaaagaaaaagagaagagaaatgaaactgaagaactagagagtagtaagcttctgtcattatgagcaaacgc

SEQ ID NO: 1761 - DNA, 336 bp, Nicotiana tabacum
aaggctgtgccaagaaagtcagacgtttcattcgccacactgaaggtgtggaagacgtgaaatcggactgtgaaaatggaaatttgacagtaaaagggaacgtggacccctcatggctccgggaaagggtggaaatcaagacgaagaagaaggtggagctgatatcatcgccgcccaaaaaggacggcggcaatggcggcgccggcggagataaaaaatctaatgacaaaacagagaaaaagaaagaggagaagaaggacgaggagaagaaacctaaagagccccaagcaagcactgtggtgttgaagattcggatgcactgtgacgggtgtgcac

SEQ ID NO: 1762 - DNA, 440 bp, Nicotiana tabacum
aattctttcattttttgaacaagaaaaaaatcctctcccccccaaattttcctttacaagttttttcatttctctaaaagatttaaatggatcttgatttgataagggagcatcttcttgatgatgttgtttttatggaaaattattgctcatcatcagaaacaagtagaaccctttattctcaaaactcctctgtttctgaatcatttgattctttaacctctgatctcaaaatggaaaatttctcttctgatcccacaaacttagctcaaagtttgaaccaagaatttaattcttttgaatttgaaccaaaacccaacttagtacctcgtataacaatctcaaattcccccaaaaaaacaagttttaatgaaagaaaaccttctctaaatattacaatacctaatgtcaagaaaacagaggaatcaaaaacagaggag

SEQ ID NO: 1763 - DNA, 493 bp, Nicotiana tabacum
ttttgaaactaaatattgcatgttaatacgaaaccaaaagttccaaattgatattcctaatgaatttctgccactgcagatgacaccaacccttcaccaagctgccacaccattttgcagaggcacgattttcagaggaaaataactctagaaacttgaacaatggagtctagctatataacattagctagcagcagtacgaagaaacaactaagcagaacaatccatttgggtaccagttagaatactaggtatcataatattaagacatttccatcctaatgtaggaacagcataggttcgataagggtacaggaaatccagaagtgccaaagcagaggaagcctccgcgcagttcttcaaattaactggttcaatattcaaccatattgcataaagcagaaacctcaccgccactcccagtcttcagcaaatcaacttcaacatttgctaggcaggcctcagcccactaagatggcatgtatgtagaagt

SEQ ID NO: 1764 - DNA, 381 bp, Nicotiana tabacum
gcgaggattagctttgctgcgcaggtaaataattacaggaatacagtgcaacaagtggtgcaaatactaggagatgaagcttcagctgcaaattatttgagcaagtgcatatactcagttggactgggcagcaacgattatctcaataattatttcatgcccctttattactccactagcagacaattcaatcctgagcaatatgctgatgttcttattcaacagtacactcaacaattgaaggtaagtttacctatttaagttaattctttatttattttcgacaaattaactcacaccatccacacaagtcaactctaattgtgctttcgcgtatttgtgtattgcttcagactttgtatgactatggagcaaggaagt

SEQ ID NO: 1765 - DNA, 387 bp, Nicotiana tabacum
tgcttctagtgcaccagtagtgctgaatgtccagcaagatccgcacttgccctggttcttgactgggctgacaatcccagcttcccgccagtctttcgtctccggcagaacaacgttagtgactttgagattgccctttgtggtggctgaacagttttgatgctgcccccaacctgtctctccggaactcgtcccatgttaggtcggtaaactcattgacaccgagtttgtatgatagtcctttcttgttgtgcgatcgaatcatcttcaaattgtccaaaaatacctcgaacctttgctttatctcctcaactgactcgtacctcttcccatacctgtgagcaaagcgagcgaaggagagagcatggcgggtcttgccgacgactg

SEQ ID NO: 1766 - DNA, 375 bp, Nicotiana tabacum
gggggtgaatagtctcgatgtctacctggatatttccctctgccaaatccacgaccacgtggtgggccaccagaatgatcaaaatcaggactataccgatgatctgcattcctatggcgctcaggtgaaacagaacctgcacgtattctatatccatgagtatcggagaatcgaccggaacgtgaatagggtggtgcatctggacgaacctcgccgggctcgtagtcgctaccaacaccgtcactgtcattatctccgccgctgtcggtgggccttacaactaggctgctcaggtgcagcgttggctggtcctctcgcgaacccatattcttctctctctctcttgccgcactgtgcggagtgtctttttctgtg

SEQ ID NO: 1767 - DNA, 391 bp, Nicotiana tabacum
  modified_base (151)..(151): a, c, g or t
ggtatgtcatcgtcgtcactctctgcatctctttcttcctcaaatccctctttaatcttatctcctcaaattccaaatccaatcacaaaaacaagaaactcccaccgggaccctacacttttgcggtgatcggaagcttattatgggcgangaagatccttcgctgatttggaaccaatccttcgtaacctcaaggctaagtatggtcctctaatcaccctcaatattgggtctcgtaccgccatattcgtatccagtcactccttagcttaccaagctttagtccaacaaggcgctgttttttccgacaggccaagagctgtccccaccagtgcagtcgtcagcagtaaccagcgtaccatcaactccgccccttacggccccgtttggc

SEQ ID NO: 1768 - DNA, 260 bp, Nicotiana tabacum
ggcggccacgttaatcccgccgttaccttcggtgctttcgttggtggaaacatcactttgtttcgtgggattctctacattattgcacagttgcttggatccactgttgcttgcttcctccttgaatttgccactggtggcatgagcacaggagcatttgcattgtcagctggtgtatcagtatggaatgcttttgtctttgaaatagtgatgacttttggacttgtttacactgtgtatgccactgctattgacccaaa

SEQ ID NO: 1769 - DNA, 473 bp, Nicotiana tabacum
ttttgtttgaaaatacatgtcgttaattataagatcttgcacataatatcgcaagtagctagatcatcaacacatgattcgtaagagtactaaagagttcataataatatcagatcatacatcaagctgaattcatatatcctcccccccttaattaagaccacttggactttttacagatccagttcttcagaggattacaaatattatatacttttaactataagttgctttttagtgcaattatttaagttgtttatatatatcaagcagaagtccatacatatataacgtgaaatggacattcatttcaattagtatggactttggcctatgacattacctggaggatcatagttgcaagagacaacatatcctccattgttgcacttaaccctagcacatccaacacgaaaccgagttacgccaaaccacctgagtatagtgtccacacacctgtccttgtgcacaag

SEQ ID NO: 1770 - DNA, 258 bp, Nicotiana tabacum
aacttatgtgtgccgtgggccaagggaggcaaaggaagttacacaacagacccatccaagctctatatcactcctcaaactcgtgcatgtgatctaagaggtaattagcagcgagctcctcatttttattgcaggcaaagaaaacttctagtacaaggtcatgatcgaagcccatttgctcaagacgttctatggcttcacgctcttcgggtgttacttgtatagcctgtggcattgctgctgcaagctgtcccagta

SEQ ID NO: 1771 - DNA, 480 bp, Nicotiana tabacum
tcaataacatccagacagaacgagctggtagacacctgatgaaactcgacaagaatccataaggaccacaaggtaccaatttcagttagtacaactttgacaccacatttaaggcacagtaacttgacaaccgctgcaacaggaaggtgacattactgactttcagacacccacactgagcaatgctggacgacaactctggaccttctcaacccttaaacaagccctagtactcactgatcattctcatcatctgattgtgaaggagactttttggactcagatggtttctccgcaccgcaattctgtctgttacacttggtccgaaaaggataatttatgttgttgcatttctcacatttccagcttccctctggtgtttctggcttagtattctttcctgatttggaaacctgagaaccaggctttggagtgttgcacttcctcatgttacaaactgttctaaaagaaaagttgaca

SEQ ID NO: 1772 - DNA, 440 bp, Nicotiana tabacum
gaattactgggacagggcgatatcaagaagccaaaacaacgggtggctttaaaaaacgacatgtggagtgtaaaacctttgtccgatggccagacgaacagagttacatttaacttgacaccggaggttattcatcagatttttgctgagaaaccagctgtccgccaagcatatttgaaatttgttccgggcaagatgtcagaaaaagaattctggactaaatattcaagagctgaatacctccacagcacaaaaaatattgttgcagcagctgctgaggctgctgaagatgaggagcttgcggttttcttgaagcaagatgacatgttagcatttgaagctcgtaagaagatcagaagggtggatccaactctggacatggaagcagatgaaggtgatgattacatgcatctcccggatcatgggctacctcttgatga

SEQ ID NO: 1773 - DNA, 449 bp, Nicotiana tabacum
ttttccaaaaaagtttttttttaatttgcaggaaattacaagaatgcaacaaaagtattctaattttggggatcatgacttgggcacttatgaaaagttcacaaattcatattgtgcttggaattgttgaatgaatgaatcaaaagtaaacatcatctaagcttcaaacataatgcaatcaattgcccgtttgcaaatgccagtcattgtagcctctggtccataaacctcaaggggaactccaagttcctctcccagggcacgcatttgggctagtccagtctgataattgggaccacctcttcgtacatagatgtgcattctagctgcctttagcttggcttccttctccctgagagcccgaataatcccattgaaagtagcagcaacgtcggtgaagttagcaataccacctccaacaatgagagctctcttacggccatcaggat

SEQ ID NO: 1774 - DNA, 525 bp, Nicotiana tabacum
ggaatgtcaatttctccttcagaaccacgtgcaatatgcgcaattgtactcagtctaggcctgcagatcacaactcaaaatctgcagttagaccaatgcaagctccacagagctattcaccctctgctgcatatgttgggtctggtgcaccctcttcaatgtatatgggggtagcaccttatggtggttctctgttcaatggaccatccatgccagcttatgacgttccattttctgggggttcagcttatcattacaatattgggagccgcctttctgggggcagcccataccgcccactacatttctctgctccacctccttacactggtgggtctgtgattggaaatggtgggatgtatggtgtgccaccacatatggaccgatacggtttggcattgccaatggcccctgctggcatggcaccaaggccgggtttttatcctgaagaaaattctcaaaagaaagatggaacacgtgataatgactggaaatgtcctaaatgtggaaatgtcaacttttctt

SEQ ID NO: 1775 - DNA, 487 bp, Nicotiana tabacum
ttttagagcaaaggtgattagcagaatatgtggttaatgtaagatgtgactacaattagactttcttactgtttgtggggggtttgaagtcgcagtacaatatgaagggacaactgatactgagctatattaacacctctataaatatatttactgcataattggtttcaaactcctagtaaatattaaattaccaaagaatattgtggactacacgtccttgtttattcatcaagttcctgatccctgatccactttgtggcaacccatttttcgcctctgattactggacagctcccgtgaagagatgtcggatcaattgtaccatttggaaacagtgagtagaacagtagtccatcccctctacgcggcttcactttcaaaccaatacacttgcggaagtcataattagcatccatgttctgcccattctcgaaaggaaacatggtttctccaccttcttccacatcagataaatacaataaga

SEQ ID NO: 1776 - DNA, 374 bp, Nicotiana tabacum
ttttccaaagcaactccacgttagtgttataaaacgagtttaataaagtttgactctgatactatgtgaaagaatctaagcactaaaacaaaacctttaggcaatagtataacattgagatgtttcctttctaatttaaagaaggatagaagttcagtgcactctgctcacaagatgtagtacaaggattcttgaaccaaggattttgatggacttcatgttgagattggaaaactgaattcattactggagatcattgttcatggccctataaatttgaaatttcaaagatacaaatcaaattacttatatgtggcatacaacaagacactactaatacatagcaaaaaaaaagacaaccaaaacagttcagc

SEQ ID NO: 1777 - DNA, 525 bp, Nicotiana tabacum
gggaacaaaagctggaactccaccgcggtggcggccgctctagaactagtggatcccccgggctgcaggaattcggcacgaggtgaacgtatacatcctcaacaaaacagacaccatgtgtttggattttaaatacaataaaatgatacagaaatacaacgaaactagctgggagggaccagacgcatcttctcgtgtggcatcgcggtcatggtactatcaaacgtgcaccgaatttggtttctatcaaacatctggtgagccgcagaatctccttggaagcagcattccgttagagttctaccaaaaaaatgtgctcggatatatttggatctgcgttcaatgaaaagttactagatcaagcgattgatgagactaacacaatgtatggtgctctatctctacatgtgaaccgcactgttttcgttcatggaactgttgatccgtggcatgtgcttggagtaacaaaaaaaggttatcctggagccaaggtcattataattaagggagctgctcattgtgcaa

SEQ ID NO: 1778 - DNA, 486 bp, Nicotiana tabacum
ttactgggacactggtacctgagttgggaatgttagccaatcttcaatacttgcaacttgaatataattcatttagcggagcaattccaagccaattaggcaacttgacaaggctattgagcttgggattagagaataacaagctgagtggccctatcccatcttctcttggcaatttaaaatcattgcgatggatgagattgaacggtaataaattatcagggaaaattccaatcacagtcttgaagctcatctactggggaaatttgcagctactgaatgtttcagacaataaactagcagggacggtccatcgtgctaaccaaacaggatttgcaattacaacaatagttcaagacgtcaaggcctaagatcattaacctttggaattggattgtcctgcaaagttgctttctatattaaaatgtgtcaagtcaagtcaactcaagattttatatttatgattttcaataatcaaaatgtgat

SEQ ID NO: 1779 - DNA, 455 bp, Nicotiana tabacum
attactgggacaccatgaaatcagcagtggctgatacggttaacactggaggtcgtcaaggtggtgcaatagttgctgctctcttcctgaagcagtttgttgacgatgaaggttcaatggatgcatatcgacttagctggtcctgtctggaacgataagaagaagattgcaacgggttttggtgtttcgacactagtggaatgggtgctgaagaactctacaaactgagccagtcaggttttcgccatataatggccaacagatgagagagttataatctcaagggacttttgatgtttgagaagaagtacatcatgttttatgaataaatttgaggtgagggtggtggaaaaggaaaaagcaatagtatgggcattgatcttcataggtagattggaggatactttagctctgctttccttgtttccttgatttataaaatgtctaaaaattgg

SEQ ID NO: 1780 - DNA, 513 bp, Nicotiana tabacum
gtctgcgtgctccctgatcctcctttctagctctggtctaaagtgcctaatgaggccctgaactggccaagcagcagcatcacccaatgcacaaatggtatgcccttcaatctgtttcgtcacctcttggagcatgtcaatctcttctaattttgcattgccaaccttcattctttccatgatcatccaaagccaccctgtgccttccctacatggtgtacattgaccacagctctcgtgcttatagaagtacgatgagccttgcaattgcatctacaatatcagttgacttgtccatgacaattacagcagcagtccccaaccctgactgcacagctttgagtgcatcaaaatccattagtacatcctcacatatgttcttgggaatcaatggaacagatgaacctcctggtataacagcaagtaaattgtcccatcctccacgaacaccaccacagtgcctctctatcagctccttcaatggaatactcatttcctcttccactgtgcagg

SEQ ID NO: 1781 - DNA, 544 bp, Nicotiana tabacum
attccctagcactgaccaccaggcgcacataaaaagatcactatgcttaacaaacaaagctgaggggatacatactatgatagaaattagaatcactggcagaacgtggaggcagaacttctgagagagagcacaaggacgacaagagctcttcttgaccatgcacaataaaaacccagtgtagtttttgtcactcgccaggaaaaatcagctgagggagagtcaggaagatgtgatttacgtcctagctacagtcagagtcacatgtgaagttggcctgaaccgtctttatgtttcaaagagatgtttgcaaattgttgatcaagatccctactagtgctgcgccgatggctggaagatgattgctgttgctgctgtgactgtggcagttgctgttgctgatataatgctcgtagtcttcctctttctctttcgagtacttcatgctccaaatacttaatcatctgttcttgagctaagttttctaagcgctgctttagggctttattctccatgctgagaataagactctgctggttaagga

SEQ ID NO: 1782 - DNA, 477 bp, Nicotiana tabacum
ccaatttcagctccaactcttcgatgttctgccctcggacaaggttaatgcctgcttgccatgtgtcacatggtggacgatgaaatgaatcctaccgagcaggaattatctctggttttgtcttcagagaataagaagagcagtgtatttggtggattgtctttacatcgtccagtgcacaagagagatccagtcggcaaaatgttttgttctgtcggggcgtatacatatcccgggagcattgctgaatctccttcacagacaactgaagaaaagattggggtgctacttttgaatcttggaggaccagacacgcttcacgatgttcagcctttcttgttcaacttatttgctgaccctgatattatacgtctccctagattattccgatttctccagcgcccattagcacaactcatttctgttctcagagccccgaagagtaaggaagggtacgctgcaattggtggcggttcc

SEQ ID NO: 1783 - DNA, 481 bp, Nicotiana tabacum
ttttagtagtacgtacctaattctgatattgataaagctaaaacatatgttacatttgatgtatcaaacaatttgcatggtgttttcttctatcaaaagcacaaccaagaaaggacaaaaggttgtattttcagtagtagaagcttaatgtactgaaagggcaagaaaactgaacattggcgccactaggtttgcttcatgttctcttaatcttagaaaacgttccagtctcagagaaataggtgctttgcgttccgctgccaagctgatttgcaagcgcctgaggatttgatagctcgatcccttgcactggggtgaaggccaaacttgaagtcaaccctgatgtggcaccactgcttccataactcttctccttgaatttctttgctactttggcagcaagcttgctttgaccaactgatacacgcaacttgccgcttccagcctgaccaagcatgccgtagccctcccctagtccatc

SEQ ID NO: 1784 - DNA, 497 bp, Nicotiana tabacum
ttttcacttcattcctatgtaattgctgtgtgtttgtgttaattcttcaaaccaaaagtaaaaaatcagttactagtagaaagtgaagatatgaggatggtaagggctattgattcttcagagtgtccaaatatttgtgggtttttagttgttgaagcttatcctaaaaggtattcatctaagatcccttctgatttagtccttctcttgggccttggctttattgattggtaatacattctccttttttctagtcccatatcaattttcttgatttttacataatcaaaaatacatatagttctgttattagatgcaaaaagatacagtttttctgtaggttttgggggaaataaagactatggggtttccaagatttcatttttatagcttttctttggagttttatagctgttgctgaatattttgactattttcctatttggggtttgtagttatgtgatgaaataagttaaagggatttagtggtggtgtga

SEQ ID NO: 1785 - DNA, 512 bp, Nicotiana tabacum
ttttaacatgaaccccaactgtaaaacccaactgaaaaaaaatggaccaaaaagacacaagtcgaaagaaaccaaaaaaaacaaaatgataatttatcctaaaacccaaatccctaaggtataaaccagtcagaaactaaagccaagtaaagaaacttgcctatgaggatatatggggcttccatacttcctgaaatcctagaagcagatgaattagcctttgccactattgacttctctcttgagatttcttaatgcaagaaccaactacaaatgcagctaggacaaaaagggcagcccaatggttatgagatctaaccaagcaattgcatgcaaatcatgtagttaaagctccattgtaggacctgttaaccactgaccaccctttatgagctgaagctagcatcaattaacaaccccatttgcaatccccttagctacaggtttcttgtcggatacagtgactggtttagcaaccttcacatcgtctcctaattttgtaactgatccat

SEQ ID NO: 1786 - DNA, 274 bp, Nicotiana tabacum
ttttgtataaactattggattcaatcaacattcagccatctggatatatgacaaagaaaagatcaaattttcataacatactatttatgttttctttttgtaactggtgctaatgagctatgagacaatacattttttagcagaattcagtgtttactagcacaaaaaggaaagacaaatttgttcaagaactaggaggtgcttgcacccattgacaagcctctcacagcaaccttcacagcagctacaacactgcgctgtctcatctctggat

SEQ ID NO: 1787 - DNA, 469 bp, Nicotiana tabacum
aaactttgaaggtcatgagtacaatgatttgtacacttgtgcccttcagtttcgaatgttgagacaacatggttacaatatctccccaaaaattttcagcagattccaagatgcaaacggcaagttcaaggagtctcttagtaatgatgcaaagggtctattgagctcatacgaagcttcacatgtaaggactcatgaagagggtattttggaagaggcgcttgtttttcccactgctcatcttgagtctgcagctccacatttgaagtcgcctctgaataagcaagtgacgcatgcccttgagcagtctctgcataaaagtattccgagagtcgagacgcgctacttcatctcaatctatgaagaggaggaactgaaaaatgatgtgctacttcgatttgctaaattggattacaacttacttcagatgttgcataaacaagaactcagcgagtatcaaggtggtgga

SEQ ID NO: 1788 - DNA, 504 bp, Nicotiana tabacum
cacatttcaattttgccatctcttttggacagattaaagtttcaaactcagctctcataagtgccttcatgactgaacttgaacctgatacacctgtaactcagtgtgattatgagcgcctacaattgtcaaccaatccatatttggaaaggaatttggaatttttgattgagtgcatggatgacttgtcaatggaacagcaaaagttccaattttactatcggaacctttcccgtcaacaagctcagcagcaagcttggcttcaaaagaggagggctgagaacatgtcacgtaaagctgctggagaagagccactaccggaggaagatccttctaatcccgtctttaagccaatcccagaaccctcacgattggacagctttctcataactaatcaaatagcaaactactgcaaccagattaatggtgttgctggacagagcttcagtagactttatctgatgaaggctcttcacgagaactgaggaaatctatggaggagta

SEQ ID NO: 1789 - DNA, 509 bp, Nicotiana tabacum
ttttgccaatctaactactaccataacaatcttacagttgtcccctataggaccacaaaacaacaagaactcaaccccgttttcgcactgaaaaatatcataaatccaaatttgttgatgagtaatatacaactgcaggaaaatataggtatcataagtttgagaggctagtcccaagcactagttactccaggaccatatcccccgctataattgccataaccaccactgctgttacctccatcatagtaactcacaccacctccaccacttctattgtaagaggtatccctcctgaagtcacgcccaccaaaacggcctccgccagaccgcctgtttctacctcctccgtatgaacggctagcataacgagtcagccattcaggtacctcctgattagcttcttgcatcaggtcagctagcggtttggccattgaaagattaccttcattaaagaaagcagttgctaatcctgacttgcctgcacgacctgtcctgcctattcggtg

SEQ ID NO: 1790 - DNA, 555 bp, Nicotiana tabacum
attgcttccgcgaggatctggctcaccttctgagatctgttcaaaatcaagaaaagatcaagctgcaactgaccgccacaatacaagtcttgaaaaaagctggccgtccctcagagcgtctggttagtcatgaaaattgtagatacagtaagccaactgtacatgaatgcgtgcacatccagaagataacggaagcatcaggcactgaagaagcagaagctgatgcagaatttgataatgctctcaaggacgctattcaaggtgttcaaggtgcagtaacaacaataaatgaacatttggaagaagttaggtatgagattgcagcacttgaagaataaagattagttggttgactttgccttttatgttttctcaatggctcattgctaccgaaggtcaccccataagttccaggctgatgaaggattatcatgtacattgttcgtcataacagtttttagttgtataggcgacaaacgttttattgttgatggtgatcatggcaggtagaaaacaagctacacaatagtttatctgaatagcagataacaccct

SEQ ID NO: 1791 - DNA, 317 bp, Nicotiana tabacum
aatggagattggctatgtgtgggcagtcgcagctggattcaacgctgctcttgcagccatctctgccaaattcttctcctcccagctcatcaaatatggttgtgtcgtaatattcaatgtcacaatgtggggatgctatgtcaatagccttaaagctctatcatctctacaagctactgtgacaaactttgcaaccaactttttatcatctggattggctggatttttacttttccaggagccactaccaattcaggggttggcaggtgcggcactgattgtagtctgagtaactgttttgacctagtcaggcatcg

SEQ ID NO: 1792 - DNA, 476 bp, Nicotiana tabacum
ccatcaacagcatatggatagtcctgaatcagtaagcgaatgccatgtggggagctcgagtcctcaacagctactcctcttttgatgagatcagtaggaagtgcttgttcagggaaaacccagtctttgtaaactactgctgacatttccatggaatatttggctggaaaaactgtcaactcaagaagtccaccaccattgatcaagatctgtcttgctaaagcatttatgttcatcgtctcacggaaatgagggtggagaagcttataaatagggtgaagcgcgcttagttgcctatttgttgcaatcacgaatggctctatcactgcatgtgtattcaaccagtgactgatgagttgatgaacgcccgagtcattcactgctgcatatgctttggccaactgccagatagaaccttcaacaccgtgatcagctggtgtatatactttgctaatagcgccaaattgatctccatc

SEQ ID NO: 1793 - DNA, 551 bp, Nicotiana tabacum
acccaaccatcacgtgctgaactcgaaggttcaacaacgtataagactcggtaaaactacaagtgcacacacacaaaagactaagacaatatggataagcttcacccttgcaagatttgatgatcaatgcaagatagaagctaaaaactagtggcaacaagaagtaggaccagacttgaatctcttaatccaaaaactcagcatctgaaatctcaaagaagtatggctggaagaaccggaaaaattccggaaacagcttcagagtgggagctgcaaaaaagagaaccaaccatatctctggaaaaagtgagctgaggtactggaccattagaagacccaagttaaaggaccaaaaaaacttcatgctaacgctaccaacggaaactttactggactagttaaacttcttagctacggcatcttcaatggcaacaacactcgctaagctacacggatctctgcttaagcaaggatatcacacctccagagttgttctaagagcagatcaacggcactgctactgatttcattgcagtgctgaatgttcaagc

SEQ ID NO: 1794 - DNA, 506 bp, Nicotiana tabacum
ctctatctaagcatacggttttcccatactttaacctacgccatgagcatacttgacaagctctgggacgacaccgtcgccggtccccgtcccgatactggccttggcaaactccgaaagtcctctacctttaacttgggctcaagttccggcaaggaatcagaaggaagtcaagagatggctagggtgacaaaacgtataatgatagtaaagcctccagggaatctgagtaaagactctcctccagtttcacctgccagtgctagtgccggttccactcctccggtatctccctttgctggtgggggaggaaaggaggcatttcgattccgcaggcgatcagggccatttgcatacgagaatgctagtgggattggacccagaagccctcctcctccttacgacctatgagatatgaattgaggctcaacatgcatgttccagctgcttaattgactgtatgttctgtgtccgagttgttgttacgcgcgcttgtcgtggctctg

SEQ ID NO: 1795 - DNA, 317 bp, Nicotiana tabacum
aacccagccaccacacctccgctacataaaaaaactaacaatatttacaaaaacagagccacgacaagtcggacacgtaacatatatagagtcaagcagctgaaacatgcatgttgagcctcgattcataactcacaggatcgtaaggaggaggagggcttctgggtccaatcccactagcattctcgtatgcaaatgaccctgatcgcctgcggaatcgaaatgcctcctttcctcccgcaccagcaaagggagataccggaggagtggaaccggcactggcaggcgaaactggaggagaacctcgagccacatat

SEQ ID NO: 1796 - DNA, 510 bp, Nicotiana tabacum
gtctaagcatacggttttcccatactttaacctgcaccgattcgctaacctacgccatgagcatacttgacaagctttgggacgacaccgtcgccggtccccgtcccgatagtggccttggcaaactccgaaaatcttccacctttaacttgggctcaagttccggcaaggaaacagaaggaagtcaagaggtggctagggtgacaaaacgtataatgatagtaaagcctccaggatatgtgagtaaagactctcctccagtttcgcctgccagtgccggttccactcctccggtatctccctttgctggtgcgggaggaaaggaggcatttcgattccgcaggcgatcagggtcatttgcatacgagaatgctagtgggattggacccagaagccctcctcctccttacgacctgtgagttatgaatcgaggctcaacatgcatgtttcagctgcttgactctatatatgttacgtgtccgactgtcgtggctctgtttttgtaaatat

SEQ ID NO: 1797 - DNA, 631 bp, Nicotiana tabacum
aacccatttgctaacatatctgtcttgcctgtcaggttcccaggatctgtatctttctcctgcctgcttgaagttgttctctttctcaatgacacacatttcacgccttcctgtcaagacacgagaaggaattgggtactgttcagcatgacgacaaggatcgaaccttgagggcaaataatccacctcttcatcgcgatgcatgaagttcatggcaccatcgcggtgattattgtgatgagcacacttgggagcattaacaggaagctgcatatagtttggtccaatacggtgtctctgagtatcagcatacgcgaatatcctagtctggagaagcttgtcctccgaatagtaaagaccagggacaatatggccagggttaaacgcgagctgctcgttctcagcaaagaagttatcgatattcctgttaagtaccaatcgtccaactggcatcaatggcaagatatcctcaggccaggtcttggttacatcaagaggatcaaagtcgaatttgtctacatcctcagtgtccataatttggataaaaagtttccactcgggatagtttccagcagcaatcgaatcgtagagatcctgaatggcgtggctatgatttgtacctccgacccta

SEQ ID NO: 1798 - DNA, 526 bp, Nicotiana tabacum
agccaccacacctccgctacataaaaaaactaacaatatttacaaaaacagagccacgacaagtcggacacgtaacatatatagagtcaagcagctgaaacatgcatgttgagcctcgattcataactcacaggtcgtaaggaggaggagggcttctgggtccaatcccactagcattctcgtatgcaaatgaccctgatcgcctgcggaatcgaaatgcctcctttcctcccgcaccagcaaagggagataccggaggagtggaaccggcactggcaggcgaaactggaggagagtctttactcacatatcctggaggctttactatcattatacgttttgtcaccctagccacctcttgacttccttctgtttcctagccggaacttgagcccaagttaaaggtggaagatattcggagtttgccaaggccactatcgggacggggaccggcgacggtgtcgtaccaaagcttgtcaagtatactcatggcgtatgtaagcgaatcggtgcaggtgaaagtatg

SEQ ID NO: 1799 - DNA, 589 bp, Nicotiana tabacum
catttgctaacatatctgtcttgcctgtcaggttcccaggatctgtatctctctcctgcctgcttgaagttgttctctttttcaatgacacacatttcacgccttcctgtcaagacacgagaaggaattgggtactgttcggcatgacgacaaggatcaaaccttgagggcaaataatccacctcttcatcgcgatgcatgaagttcatagcaccatcgcggtgattattgtgatgagcacacttgggagcattaacaggaagctgcatatagtttggtccaatgcggtgtctctgagtatcagcatacgcgaatatcctggtctggagaagcttgtcctccgaatagtaaacaccagggacaatatggccagggttaaacgcgagctgctcattctcagcgaagaagttatcaatgttcctattcaataccaatcgaccaactggcatcaatggcaagatatcctcaggccaggtcttggttacatcaagaggatcaaagtcgaatttgtctacatcctcagtatccataatttggataaaaagtttccactcgggatagtttccagcagcaatcgagtcgtagagat

SEQ ID NO: 1800 - DNA, 243 bp, Nicotiana tabacum
ggcatttccgcagctccaatccccttgattcgaaaatggtgaagggacgccaaggagaacgtgtcaggctatacgtcaggggaactgttcttggatacaaaaggtcgaaatcgaaccagtatccaagtacttcactgattcagattgagggagtgaacactaaggaagaggtggactggtacctcgggaagcgaatggcctacgtttacaaggcaaagacaaagaagaataactcacacttcg

SEQ ID NO: 1801 - DNA, 240 bp, Nicotiana tabacum
agtgtgatggttttggtcaaattggtatttggttcttgtactttcagatcccttttttagcagcctcaccactaggatcagcaatctttagcaagtagagtaccctgtccaactctgactgaagggtggagagttccttatgaagcttttccttcttctcatgagctagctgcgaggaaagcccagacatgtaagcatccagttcatctccagcttcaacctcacattcctgacctgtac

SEQ ID NO: 1802 - DNA, 562 bp, Nicotiana tabacum
atttcaaagtgcactttaagatcggcgatttcaaggaggacttttcttccttcagttacagcattcataacagttcctccaccggtttaaagcaagcacgcagacggccaggcgtaaactcttccagcggcggtgcgctactacaaatttccatcgcatgcggacaacgtggctggaacgggcaacctttcggtaatcgcagcaggtttggcggattacccgggatggtcaacattgtttcaccttccgcatcgagacgcggcaccgcgttgagcaaaccgatagaataaggatgaacgggttgataaaagacatcgcgcgcgttgccatattccatcgtgcgcccggcgtacattaccagcactttgtcgcagatccccgccaccacgacaagatcgtgggtgatcataatgatggcggtattaaattcccgcttcagttcatttaatagcgtcatgatctgcgcctgtacggtgacgtccagcgcagttgttggttcatccgcaatcagcagcttaggtcgacataacaaggccatcgcaatcacacttcgccttctttg

SEQ ID NO: 1803 - DNA, 262 bp, Nicotiana tabacum
tgtgattcaattcgtggaggtatgcacaacttatgacttgtcaagcaaatcataaaatggaaaaattggatgaacaaaatttcgaattcgctgctagcaaaaatttagataagattctggttattctggaaagcaaagttgaatacagaaattttgataagatttaaaaaaaaaagttaaataaggaaatgtggcagagaagaagttggaaggctgaagggggatgcgtaaaggttttttccttcggtctcggcaaaggtta

SEQ ID NO: 1804 - DNA, 84 bp, Nicotiana tabacum
agtgtgagcagctgaaggtgccaccgtctggaagctgacccagcgtgcagactcaactgaggcgacatcagactcatcacattc

SEQ ID NO: 1805 - DNA, 515 bp, Nicotiana tabacum
ggtactgcatcttccatctatgtggcatctgcgttggctctgaaactgggtatgaagcgcgaacacatgttgcagcagaaagtggaaaaagaaggggcggatcagccgtcaattctgccgtaatcaagttcccgttgatgttgaaaatcccggtcagaagatcgggattttttttgatgtatggagattgcgaaaatccccgcatcttgggaaactgcgcgtaaccctacatttcatccaggtaacttttcatggctatcatcccaaaaaactatgcgcggttagaaagcggctatcgcgaaaaagcattaaaaatctatccgtgggtctgcggtcgctgttcccgcgagtttgtttattccaacctgcgtgaacttaccgttcaccacattgatcacgaccataccaataacccggaagatggcagtaactgggaattgttgtgtctctattgccacgatcatgagcattcgaaatataccgaagcggatcagtatggtacgaccgttatcgca

SEQ ID NO: 1806 - DNA, 171 bp, Nicotiana tabacum
ttttctggtgtgctgactgatgagcgcggcagggttcaagctttatggggaagcttttcaacacagctcaaatatggttgtagttcatcagaagatcaccaatttgtccggggtattccaatttgtaccttaagccaagtccttggcaagattatttccagtaccgaacgg

SEQ ID NO: 1807 - DNA, 521 bp, Nicotiana tabacum
cggtactggcgctctcttcgtcttttactgtcaacgcagctgaaaacgacaaaccgcagtatctttccgactggtggcaccagagcgttaacgttgtcggaagctatcacacccgtttcggaccgcagatccgcaacgatacctaccttgagtacgaagcattcgctaaaaaagactggttcgacttctatggttatgcggatgcgccggtattcttcggcggtaactccgatgctaaaggtatctggaaccacggttctccgctgtttatggaaatcgaaccacgtttctccatcgacaagctgaccaatactgaccttagcttcggtccgttcaaagagtggtacttcgcgaacaactacatttacgacatgggtcgtaataaagatggtcgccagagcacctggtacatgggtctgggtaccgatatcgacactggcctgccgatgagcctgtccatgaacgtctatgcgaaataccagtggcagaactatggcgcagcgaacgaaaacgagtgggac

SEQ ID NO: 1808 - DNA, 507 bp, Nicotiana tabacum
gtcagctggtctcccaattattatactactgtagtatagaaattctgctgctagtttttttatccttctcgtcccctccctcaaacccctttaccaattcgaagaactcaattttgatggcggaagaagagaaatcagtgcaagaggagctttcacttccgattttacttgctgacagagtcattaaatcagcccaagaagctgaatcatccaaagtggaatgtgccgaactggctcgtcacgctactcagctcagccaattcctccgagccactgttcgtctcaccagttcgtcccaatcccagtccctctacgaccgtcccatccgccgtataacttctgaagttaccaaaactctggaccgggcacttactcttgttcgcaagtgtcgtcacaagcccaatctcctccgccatgttctcgccatcacttctactgcagacttccggaaagtctctacccttctagaaaattccacggcggacgtcacgtggctgctctccattt

SEQ ID NO: 1809 - DNA, 528 bp, Nicotiana tabacum
actgacatcatgaccgatagaaccggtatagaacgtcgaggtcaggttggtctggttggtgagaattttattactcacatctttggtattcgccgtgcgtgaccaggtccagctattcacatcgctggtgggctgagtaatattcgacgccccgcccataatcgccgtcatcaggtaatcctgctttacgcgcgaccaacgggtagtattgcgaatggtggtgttatcgttgatgtcgtgctcaaaacgcatggtggcggtgtcggtggtcgaatcgtcgtaatcggaatccgtgccgtaaaagttatgagtatcaacttttccggaatgattcagggccgccgttcccgcagatggggcagaatagcccggcaaaccgatggtcggaatgccgccgtctggcgtgttgtgctgggtgacatgcagataattaagatacaaacgattcgctgtaccaaggccaaaagcgacagaaggggcgacgccgtaacgctcatttttgactttgtcgcgtccggcatcgtgcgt

SEQ ID NO: 1810 - DNA, 554 bp, Nicotiana tabacum
cttccattttacaattctagaaatttctcacacagttcgccattcatttgtgattttagggtttgaatagagagaatccaaaaaatggcggacagttcaccggcgactcgaaataactcgacaagcataacagacctcgacatggacgcattggttcactgtgcaacttatttgaatcttcaaaacctgtcaaacatggctatgtcttgtaaataccttcaaagagctgcctattctgactatatttggcaatcccttttcagacagcagtggtctccaatagtaccttctagctttcctcatataccaactgccagggaagcgtaccttgcaaggcgtagtgatgtgctgcagttcaagttcgttgaccctatcgttgtagagtttgctactgaggttaaacctcatgaaaatttgcatcttgacaaagacaatatcatattttctcagggatcttcagtccatatagtgaacattggcaattttctggatggaagtgatccgtatgtcacactcggtgatcacacctccagaattacttctatgagattaat

SEQ ID NO: 1811 - DNA, 378 bp, Nicotiana tabacum
atctgcatgcggaaatttatgggagaaaggcacaggctttttcttacgcatactgctcaaatacctccgagccttttcatttcttatcctggcaatggattctggagatggtgtgcccaacagatcggtcatcaagtctaattggtgaaccacatttttacccggaaagagaggcttcccagttaatagttctgcaaatatgcatccaatgctccatatatcaattgctggtgtatacttagagaaaaatgatccacacaattcgggagccctataccacctcgtggcaacataatcagtccaaaatatagctgttggagtatcattgaaggccactcttgcaagaccaaagtcacagatcttgagcttgcagtcggc

SEQ ID NO: 1812 - DNA, 377 bp, Nicotiana tabacum
ccactcgaacagcgtatgattgtgctgggcgcactggaagcggtcgactgggtagtgtcgtttgaagaggacacgccgcagcgcttgatcgccgggatcttgccagatctgctggtgaaaggcggcgactataaaccagaagagattgccgggagtaaagaagtctgggccaacggtggcgaagtgttggtgctcaactttgatgacggttgctcgacgaccaacatcatcaagaagatccaacaggataaaaaaggctaaccggaaagcggttcacagatctcgctcgtacatggcaggcctattgacgctgttgtttttccaacctagagtaaaggaacaagggtaagggaggatttctcccccctctgatgagt

SEQ ID NO: 1813 - DNA, 560 bp, Nicotiana tabacum
catgtctggtaagcacaatcctttactcagttgtatcaatgtgtccttcatccgacggtaggtcacctcatttgccaacttctcaaggcgtaaaggattattcagaccctcttctgggacatcatcaaaagcaacagtaatagatgagtcctttagcctgtagacaaccccctgtccaagtgcaggggagcctaaatcagctttgtttggtttcagaacaacaacgtcatgagtgccaaacttgtgaggcggaagaatatcccctttgtttgattgaagctccatcagcgtcttgcccattaaccctgtctggatatcagcacacttcaaattcagaatagtggaacccttcttctgagcagaatccaaactcctcgtctcagctgagctcatggaaagtgatatttcagcttccttttccaaatctagtaaaggggccatggtggaaacgaactggtcgacagtcatggcagttgaagatgatgatttgtttttcttgttgttgcttttccctttctccatttgctactaactgactaactctgcgatgatgatgaaga

SEQ ID NO: 1814 - DNA, 541 bp, Nicotiana tabacum
tcctttaaagtaaactactacttgttccaaaggattgaggaaaccgcggttcttagctgataatgtagagcaaacgaaatccagcacacaaatgtctgtacatacccctacaaccaacaaagtttgaattttgttgtttttcacccaatcaacaaatacattagagccatcctcctgaaaagaaccaatatagccatcgtagcaatctttacgcctgattgttacgttttgttccttctccaaccatcttagtgcaggaaccaaattggattcatcagtgccagtgatacagtgaggaggataagggtgttcaagtttgtgaggttggtgtgaatcaagaaaggcaagaataggccatttcttgtcacagaacaatctagccagcctttttgattcctcaatcatttcagagatctgcctgtttggctctcttggtgccagatttccagctccaacagagcaaaagccattgatgatatccacaagaacaagaccagctttcacatcttcagtgatgatcagtgattcctcctctatggga

SEQ ID NO: 1815 - DNA, 579 bp, Nicotiana tabacum
gtaagcacatcctttaagtgctcctcttcaacaattcaataggaagttgaatgaccaaaaaaaataaagaaaacaagtatatctgcaaataccaatctgcagaacagatcatgaatttcgtgcagattcgtcaagcatcattcctttcagactcttggccaaccaaatagccgtctccctcggtgaaaccttgtttttgccgaaaggttttagaacgacagcaagctcttctaatctgttttgctccagtaagtcagcagataattctaatagtccttcaagtgcatctgccctttgtctaaaagacttgacatctaacgtttcctttaccggcctttcctcctctgcagccggttctgaagaatctattcttggtgctgaagaggttggagtgctgttgtttcttacgtccatctccttatcatggacaccaatcaccgattcagcaaaagtagaagcatttggagtgccatgagaacctagactgtcgatatcaatttcatctcttaccacatttatcagtttcccaacatcagcacctgtctccatagtgtctgctgctggccctcgtgccgaatt

SEQ ID NO: 1816 - DNA, 449 bp, Nicotiana tabacum
ctttagaactaatgtgcatccgacatttgtcttgatacaaatgtcaccaatccccgcaatctttgagtaacttgtgttacccattttcactgtgccgaaatcacctgctacatatctgcaaaaaagatctcttaccggtgtggcatggtgagatgccgctgtgtcaaccacccattccgactctgaacctgacaggtgcatgcattcctcttcctcatttataaagaggacaacattatcattattttgcaccatggcggctgtgttgtcgtcattcttctggccactggtttcacctttgcccttccttggatttgggcaatctcttttgaagtgacctggttgattacagttgtagcaatttctgactcttgatttggatcggttctttgacttcccacgatgctccggatctaccatagttgttcgaactcctttgataactcctg

SEQ ID NO: 1817 - DNA, 196 bp, Nicotiana tabacum
tatccgccatagatatagctgcatgagttatctgcaatacgtctatgcaggcgacggcacatccatctctatctagaacaggaaggtgcagaaacttcccatcatgcattatatgcagagcctgaagtattgttgtctctaatgttgcgcattcagggcttggtgtcattaccttttccgccagtgtcagctcagg

SEQ ID NO: 1818 - DNA, 299 bp, Nicotiana tabacum
atatccgccatagaacttcctcactacagtcgacgccgattccaaatcagttacagaatcagaagaaggggatgaagtaacctccgccgtctgattgctgttccgtacaactacgtgtcttatcccacggccagaaatgatcctaaattgataatcaatagagcggttgggtttggccggagagaaaatgggggagaggtttggattgagagggaggagagagaaggatgaggtgctgctcatcagcatcaccattgctgcacttgcagtttgatgctactgtttgtgttgtgtttctg

SEQ ID NO: 1819 - DNA, 386 bp, Nicotiana tabacum
catagaccttatgggaggcaagatataggcgagtgctgttgtcgaatcccaaagctgccagcagcaatccaacttcttcgggggtcaatgggcaccgtccttgactccttaactcttcatcagtaaactgagagttgatgacccttcctccccaaattacttgccggtatttagctagagccaaattttcagccttgccaccaccaaaatcacaagctgaatgagctgccatatccttgtcgaagcgaaggtggagaacagcaaacttgcctgctccttgtttgggcttaagatcggtaacttctctgaggtagttgttactaaccatgttgccttcactaggaggattcctgaggcgattgataagggcatccccgagatgtctg

SEQ ID NO: 1820 - DNA, 451 bp, Nicotiana tabacum
gttaaaagtaaagtagaagacttcctgtttcgtttagggccctataaatagaggagggttttgtgatggcagaggagtgtgcagcatttgtattgcctgtgaagagaccaagagaagaggaacaacaacaggaagagatggaagcagccaaccacaacaacgacaacggttgcaccaatgagtctccttatatctcttctgttcttcctggctggttctctgagattagccccctttggcctggggaagcacactcgttgaaggttgagaagatattgtttcaagggaagtctgattaccagaatgtcatggtttttcagtcatcaacttatggaaaggtgcttgttttggatggtgtgattcaactcacagagagggatgaatgtgcttaccaagagatgatcgctcatcttcctctttgttcaattccaaatcccaaaaaggtgctggt

SEQ ID NO: 1821 - DNA, 534 bp, Nicotiana tabacum
cttaatgaattacaccacttcaccatagtctttgtcaggtaatcctaatacacagcattctgatatagttggatgctccaatagtactgcttcaatttccaatgctgataacttgtatccaccgaccttcataatatcagcattggtccgtcccaaaatgatgtaatatccttcttcatccactgtaacagcatctccagtcttgaagaacccatcatcagtaaatgattgcttggttacctcaggtagcctccaatattctttgaacaatgaagggctcttaatgcaaagctcccctactcctgttttatcactaccactctcatcatccaaaaggatcttggcctgaacacctgaaaatggcttgccaacagtacctcctttgcgtttgcctttaattggattagatattgccatcacaaactctgtcatgccataacgttctaatagccgatgacctgtaattgtttcccattgctgcatgacgggcaaaggaagtgcagaggagccacacatcataagacgcaagtgcct

SEQ ID NO: 1822 - DNA, 538 bp, Nicotiana tabacum
cacttattcatcatacaaaagcgcgggtagataagaaaaacagtaataatacattctaaaatccctttaattattcaagaccagaaccacccaataggctctccttcttcatgttgctgctcctctgccgccacaaagacgttacagaagtagccatggccgccgccgtcatcactaccatcatcttcctccgactgcaaaccatccataggcggaggaatattattacatcctccagcccctagtggatactcttccatatgaccagtgtgaaaataggagtccccactgtccaccagctgtggactgtgctcatctaccaccctcgtgccgaattcggccgaggttgaggagccagctcaactcattgcaagaggcttcgggaggaaagaagttatctgttaatgatcttgtaataaaggctgctgctttagctcttcgaaaagttcctcagtgcaacagttcatggaccaatgattacattcgccagtatcacaacataaatatcaatgtagcagtgcagactgacaatggactt

SEQ ID NO: 1823 - DNA, 278 bp, Nicotiana tabacum
ttttgaataccagaaatctgaactctgaattgatttaagtctctatacaggtgtacgaaaaaatgaacaagaggcaagagaccagagcgacattacgtcctttacccacggtttcttccgagttgttctacgttccaccctccatatggtgaaattacataagaaataattagaagtgtatctatttgacaacagaaaactataacctacaaatctattacagctcgtcatgtgaatcatcatcctcggcggattcctcgctggcacctcctggggct

SEQ ID NO: 1824 - DNA, 448 bp, Nicotiana tabacum
gctaggtttgggatacaatccaagcattgaccggtcagaaattgagaatgcagctgtgatacattacaatggtaacatgaaaccatggctagagttggcaatgacaaagtacaggtcatacaggaccaaatatataaagtttgaccatccatacattcgcagctgtaagcttagtgaatgaagcattgatgagagctatagtacagttgatctactcatttagctcgtcttctatgcgacagactggtcacattttctataatttggttgtgaccaatgagctcttctatgcagcaattttcttgtctccatgcgatgtgacccaattctttattcttccctgtgaatctgtgagtcaaatgtattcatcgttcagtttctgatgccttgttcacctgtaacgagtcccctctgcttggagctaagctcaactggggtaacaaagagt

SEQ ID NO: 1825 - DNA, 574 bp, Nicotiana tabacum
accacttgcggaacatacatcatcggtccctagatcgccctcttttaaggaaacacctatagaacagcttgaaccatcttgaatgaacctttagtgatgtggtgtaagcacagcaacaaaactatgattttcacaccggcctaaccaattgcttttaggctgacggttttccttcactattcgtaccccactcttcgtctgcctcatttctattaatgagtactgcaccgtcagtagacacaccatccacgaccacagcctcttcttggccctcttcttgttcctcattttgtgcatcatctgcctccaattcttgcacctcatcaccactctgttctgcaacctcgtggtccatatctccattttcaagtggttcttcatccattctcatgttgttgaaagcctctacaaggttgttagttgatctatcaacatgatttacgtaatcagttgctggtgggtagccacccctttcctctgcaactctagcttcaacagcacatgcaacttgccagttctcaaacagattaggatattcttcaggatcagccaaagcttctgctgctttctggtt

SEQ ID NO: 1826 - DNA, 311 bp, Nicotiana tabacum
cttgctgcatccacatgaattggagtgtcccacccggtttctttgttcttctcaatcaagaggtcattcaagcgcttaacatcttcaaattcaccattgagagtggaacccaagatagcagctacacaaatagtgttctcatcaaccatctctacagccttgactgggtccattacatagtacccttcccttagcttcacttctttcagttccacttcaaaatagttagcaaatttctcccagcacacctgaacattggcaccggtgacaatgttgggcttatcataaggttttccctcagctttgcgttt

SEQ ID NO: 1827 - DNA, 486 bp, Nicotiana tabacum
aaatagctcatcaaaatgttttccaaaactaacctttttctttgcctttctttggctattttgctaattgtaatatcctcacaagctgatgcaagggagatgtctaaggctgctgctccaattacccaagcaatgaattcaaacaacattactaatcagaagacgggtgccggaatcatccgtaagataccgggttggatacgaaaaggtgcaaaaccaggaggcaaagtcgccggcaaagcttgtaaaatttgctcatgtaaataccagatttgcagcaaatgtcctaaatgtcatgactaaagttaggccttgagactatgtacttgtgctggtgtgagtttaattttgagagtaaagggaaagttatgaatagcctaatataattctattcactatgttttcttagtaattcttattgttgaaacttggaacaggtctttgggtcaaaatgtacctcttgtcttgtagtctttcaactgtatg

SEQ ID NO: 1828 - DNA, 456 bp, Nicotiana tabacum
gttccttttgatgagcttgttggcatgcatggtcctgtgtttcatctggttgaaaatgcatttactgttcttgccagtaatatgatatttcttggagtagtaatatttgttcctttttcattagggcgaattatactctattatatgtcttggcttctgtcctccgccagtaatccagtattgtcaactttcatgccacttactgaaacagcacttttcttggccaatattactctgaagagtgcattgactgctgtagcaaatttgacagctgacgaccaaaaaaatggtttgcttggtcaagttgctgaaatattgaacggaaatgccaccgatctgagtgcagcatcggataacctccgtgcaacattgtcagctgaccttttgaaaggatcatccctttggggatccaggctttctgatgttaccactcttgctgttggctatatgtttata

SEQ ID NO: 1829 - DNA, 471 bp, Nicotiana tabacum
gcaacgttgtgggagcagtgtggctattgtgcagcaatatttcgcaaactctatatctcggcttttactacctgtggatggtgcgcatgctgcttcctgtgaagaaatggctacagctatgtcaagtgctgagggtgctgcttataaggggcttcagcagtgcattgaaactgttatggcagaggtggaacgcatactttcaactgaacaaaaagccacagattatcgatcacctgatgacggcattgcccctgaccatcggccaacacaagcttgttcaaaagttgtcgcgtacctttcgcgggtgcttgaatcggcattcacagcactggaagggcttaacaaacaagctttcctggctgaattggggaatcgtttacacaaaggcttgcttaatcattggcaaaaattcacttttaatgcaagtggaggactgcgtttgaagcgtgatataacagagtatggggagct

SEQ ID NO: 1830 - DNA, 436 bp, Nicotiana tabacum
atttagcatcttttgtgacaacatggatggaaccagagtgtaataagttaatgatggattccattaacaagaactacgttgacatggatgaataccctgtaaccactgagcttcagaatcgatgtgtaaatatgatagctcatttgtttaacgctccacttggagatggagagactgcagttggagttggaactgttggatcctctgaggctattatgcttgctggattagccttcaagagaaaatggcaaaataaaatgaaagcccaagggaagccctgtgacaagcccaatattgtcactggtgccaatgtccaggtgtgttgggagaaatttgcaaggtattttgaagtggagttgaaagaagtaaaattgagtgatggatactatgtgatggaccctgagaaagctgtggaaatggtggatgagaatacaat

SEQ ID NO: 1831 - DNA, 436 bp, Nicotiana tabacum
caaaaattaggcagttcttaactgtacaatttgagctgcagagtttaattagcacaagaatgaggagagtaccaaccgtattatttcaagctggtaaagctattggagatttggatttgctcaaaattgtgcaatctgaaatcaaccacgaactctccgctaaaccttttcagaatgatgaaagtagaagctttggagattttgttgtagattgggattcaccacaatctcaagatgtggttctacgcaggagatgcgaatcaggggaggaagttgctgtttctgctttattgggtgctgagagctctaatgaaaatgtgaaatttcccagggaagctttcatgaaagtaggtgtgaagaagcctggcttgagttcccgtgctagagtttgattgtgtagcaactgcccaagttggtgatggttgtgactttgaaa

SEQ ID NO: 1832 - DNA, 395 bp, Nicotiana tabacum
ggatcctctgaggctattatgcttgctggattagccttcaagagaaaatggcaaaataaaatgaaagcccaagggaagccctgtgacaagcccaatattgtcactggtgccaatgtccaggtgtgttgggagaaatttgcaaggtattttgaagtggagttgaaagaagtaaaattgagtgatggatactatgtgacggaccctgagaaagctgtggaaatggtggatgagaatacaatttgtgtagctgctatcttgggttccactctcaatggtgaatttgaagatgttaagcgcttgaatgacctcttgattgagaagaacaaagaaaccgggtgggacactccaattcacgtggatgcagcaagtggtgtaattcattaagattataagtc

SEQ ID NO: 1833 - DNA, 558 bp, Nicotiana tabacum
tacaccacttgggctactacttggattctcatatttgcgtttgtgtgaaatgggcttagaacaaacttctgagatgagttcaaagcaattattcactttctccttgctaattttgagaaccccaagaagttgattttggtattcaacagaattacaaggctcaacttgatgaataacgtggagcataattgcagtggctaatacagacggcatataacgtacgaatctacaatcagccataatagagagaaggagactttcacatcttctaagaaattcccagtgaacattattctttagcccaagcctccttataatatgatcaagaaatgaaagtggggtcactggattcatcctccattttagtgaagacaacaccaaaagctccattctttgaatagtttttgcctcaaacacatatttagcatcctccacttgaaagtctaaaagaagaggaacttgagtttcttcaactttagcagctaaagaaagacaagtaacagcagcaagttgaatcatccaaggcttatctttctgataatgaagactagtcaaaaa

SEQ ID NO: 1834 - DNA, 524 bp, Nicotiana tabacum
cagagcttcattcatagagatctgaagccatcaaacattctcttgggagatgatatgagggcaaaagtagcagattttggacttgttcgccttgctcctgatggaaaagcttccgttgttacaaggttagctggaacttttggctatcttgcaccagagtatgcagttacgggcagagtaaccacgaagattgatgtgtttagctttggtgtaattctgatggagctaattaccggaagaaaagctcttgatgagtcacagcctgaggaaagcatgcatcttgtcccatggttccgcagaatgcatattaataaagagacattccgaaaggccattgaccccacagtcgatcttgatgaagaaactctgtccagtgtcagcactgttgctgagttggctggtcactgctgcgctagggaaccccatcaaagaccagacatgggtcatgcggttaacgtgctttcatctctagctgagctctggaaaccgcagaggttgacgaagatgaaatatatggaatcgat

SEQ ID NO: 1835 - DNA, 454 bp, Nicotiana tabacum
gaaaatatgggatctgggcatatatttttcgaaccgtcttgtcacggcaacatgttgttccttgggaattcagatcctgttttccgaggaccaagatcgatgatgaagatggaggactcctcaaagaggcgacctttctttagctcgccggaggaactatatgacgaggaatattacgacgagcagtcgccggagaagaagcgccgtctcactcccgagcaggtgcacttgctggagaagagctttgggacggagaacaagctggagccagagcgtaagactcagctagccaagaagcttggcctgcagcccaggcaggtggctgtgtggttccaaaaccgccgtgcccggtggaagaccaagacccttgaaagggattatgatcagctcaaatcctcttatgactctcttctctctgattttgactccatgcgcaaagataatgagaagctca

SEQ ID NO: 1836 - DNA, 433 bp, Nicotiana tabacum
ttttctcaaagaatgatacttttgctattaattttttttgttcatttgcacctaataatgttatctttaccagagactcataatcacatcatctttaagttcatgttccacagaaatgctagttaacagtcggccagccctccccagcatccatgaattgagttcatcccaacagagagaacttttcacagatgttaaacagtttcctcgaaccaaattatacattttaagaatacaaccaaactaatgaccacccaatagacccaaaagaacctaaagaaaaaccttggattgcgcttatgcccctcagaagaaataaaaatatcatatatatagtactaaattattagccagtagtcaatgatttgctaaaagaacttaagttttcctttgcccatgtgagctttcccatgctccacataacatgctgctt

SEQ ID NO: 1837 - DNA, 323 bp, Nicotiana tabacum
ccagaacagtacattcttaaaattggagaagggattactacaatttgcatgagtggatttgctgctttggatgtgccaccacctcgtggtcctctttggattctcggagatgtattcatgggggtatatcacactgtatttgactatggtaattcccgactgggttttgctgaagccgtgtaatatcctttctttgtaattacttgccactagttacttcatagaatgatggaagtattgtaaagagatgaatgatactgctatgttattgtgttgtatctgaccgtaatatggcatactaatcttctttctgttgactaaaa

SEQ ID NO: 1838 - DNA, 502 bp, Nicotiana tabacum
ccaacaacaacaaccaacaaccaagtaaaatctcacaagtgggatctggagagggtacagtgtacgcagacattacccctaacccagaggatttgagaggctgtttccgaaagaccctcggctcagcgaaagtaatttgttcggagcagacatttcttccgaatgcaaatgatataggaacaaagaaacgggagaaataatagtggataaactatacacgctggaattttgaaagttgctacattaagcaaactaatgttgagagcattggctaagatggcttagtctgtacatgtgcagataggaccatgaggtcatccaagaacgacggtacatagtcatcttctgtagatacccttctcttcatagtgtagcaaaagatcttaactgttagaaaagtagccacttgctagcactattcacgcgtttgagttttcagtgtggttagttttttctgcagttccaagtttgacatcttttccatctccaaagcacgtgcaag

SEQ ID NO: 1839 - DNA, 486 bp, Nicotiana tabacum
ttttacataatttaaagctcggctgtcatatcacaaaagatcttggtaatagccccttttatttatatacaataactcaatcattatattgtcatactaacataattttatcatcatttttccaccctccactctagcaaaaaatacaatcctccttttatatatctatacacaacaatggtaaacaaaaatcactcttcatcctgatttccatggttcctagcatcaagaacttgacttcttgttctctttgcatgacgatggtggccgtgtttgttaaatttcaacctccccgtctctttgaaatgttgttgttcaacgtgatctatctcgcattctggtggtggcactgaatatctcaaagaatcgtaacaataagaataatacatatattttgacctaaatcttttcatagccattctttgtcttggtgtaatccttgaaaaatctgccttttgaagttcatcatctttctcgtcacaacta

SEQ ID NO: 1840 - DNA, 481 bp, Nicotiana tabacum
ttttagccttaattgccaaaactaaaatattatgtcgttgacgcaattggtgttactagccaaagcttgcagggccctaactcatccgtttctttcgcattacacagttgtacaacacaacacaatgatttttacatgaagaaaaaatgaggactgacttgacaaggcaatccccaacaggaccagctgaattcatcctccatctctcatcaattacaagacactacaataattgacaactcggcagtccatgtcagcagacagttcgaccatagcagattgatgcaatgtaaagatttttagaccatttttccttaacatgggtacttgggaaggcagatgtccgtaaagtctcttgagtctcatcaatcattttacgtcttggtacgctcaatatgaaggctgcttgatcggcagtggcagccatagaagttattctataaccactttcccaccgtcgatgtattccttcacttgggta

SEQ ID NO: 1841 - DNA, 439 bp, Nicotiana tabacum
ttttacaaacaactttaaaattcgaacttcatttttgcagtataaactacagaaatacaaatcccactacgtggtttgaagcacgataataaagtgctgatgaaatctaagacttgagttcacaatacattactaaataacatatttacacaaattaggataatgtagtaaaacccttgatcacagacaacattcctcggataagttcatctcacaggttaggattagtagtatgggcagcagtcacagtagagaccatggcatcaactccacagatattgtgacccctgcaaatcttgtaatatccatgctctccccagttttctccccaagaattcttgatgatccagtaagccttttccttgagtctgataggagcaaagccatgagaaccataacctaccaagagcactccgtgatcctgacgcttgaagcagat

SEQ ID NO: 1842 - DNA, 438 bp, Nicotiana tabacum
cataaacataatactcctcaaatggctgctatcacactcctaggattactacttgttgccagcagcattgacatagcaggggctcaatcgataggtgtttgctatggaatgctaggcaacaacttgccaaatcattgggaagttatacagctctacaagtcaagaaacataggaagactgaggctttatgatccaaatcatggagctttacaagcattaaaaggctcaaatattgaagttatgttaggacttcccaattcagatgtgaagcacattgcttccggaatggaacatgcaagatggtgggtacagaaaaatgttaaagatttctggccagatgttaagattaagtatattgctgttgggaatgaaatcagccctgtcactggcacatcttacctaacctcatttcttactcctgctatggtaaatatttac

SEQ ID NO: 1843 - DNA, 400 bp, Nicotiana tabacum
caattcacaatacaacaatattccactgcagaatcagaatcacaatgaagaacttactcagtggaaatgtggtgaatattccaatgaattcagctgtatgctcatttgaaaagcagccagaaagactattatccctatctccttgccaagaccatattccatctgcaacttcaaagattttatctaaattaaagcaaagaaaatctgtgattggtaagatgaccaaactgggagaaaggatggactgtcttgcacaaggtattcgcgaacatgtgagccttagcccgaagctaacagaaactgtgaagggaaaattgagccttggggccaaaattcttccagtatgagatgtgtaggagagaatatgcaagcagaagtttagtgttagagatgatgaaaa

SEQ ID NO: 1844 - DNA, 406 bp, Nicotiana tabacum
aaagctctttctgaacatgtatgttggcaagaggaagccatttatgccattagtcagactgtctcccatcgcagaagtggaaatggaaggcatcatggctctaggaaaggaaataatatctggctcagcttccttggtcctgacaaagtggggaagcataaaattgccaaagctcttgctgagaaagtctttggttgcagcgatagcatgctctctgtggatctgagctctagtgatgggagtagctactcaaattctctctttaaccatcaagatacaagaaacagttacgtgaatcttaggggaaagacagttgtcgactacattgttgaggagttaagcaagaagcgttgctctcttgtgcttcttgaaaacatagaaaaggctgattttcttgttcagaata

SEQ ID NO: 1845 - DNA, 306 bp, Nicotiana tabacum
agcttctactatgaaaatgtttcctgaaacatattctgaagaatcgtggattaaataacgcaccactgaagtcaaagccgggtctgatgttccatgagttctcaagggaatggttctcaatgcaatattgtggagccagtccttttgcatgaggccctctgttatctcagatctgaaaagtcctggtgatattgagttcactctgatcttgtatggtcccaattcaagggccatcatcttcatcacagtgttaagagcagtctttgaagaagcataagcaagacctcctggtaattgcccacgatt

SEQ ID NO: 1846 - DNA, 427 bp, Nicotiana tabacum
ttttacagcaaaatcgtccaatgtattaacatgttggagctacataaattagcaccacacaaaaatctcaagtaacaagtactaacatttacgcagacactagcattaaacaaaaaccattaccaacacaatgtttacaaaccttatactcaaacaacttttaatcagacagagttatagttgataacacattaaggcgcgcagtcccacatcgaacaggagaaggaggcctaggaactttttaaaagtggtctgcaagcccgtgtcaatatggttatacgacagcaaacgcatctatgttgataacaaattgaatgtacaagttttcttttttatttcatcggttgagggaggaaggggaatgttgtgctactgataggttttgaaccctccacctcattttggaaggcagagaactcaccaagtg

SEQ ID NO: 1847 - DNA, 233 bp, Nicotiana tabacum
cctcgtgccgaatcggcacgaggccgagtccctagggacattcgtggttttgctgtcaaattttacaccagagagggtaactttgatctggttggaaacaacgtccccgtcttctttaatcgtgatgcaaaatcgttccctgacacgattcgtgcactgaaaccaaatccaaagtcacacattcaggaatactggaggatccttgatttcttctctttccttccggagagttt

SEQ ID NO: 1848 - DNA, 462 bp, Nicotiana tabacum
ttttgaatatgatatgaattattaaagatatatgcgtgagacacaatctactaattaatctatttctttcaaataccccactagaaacagatcacaatttcattttataatacctcgggagctaatgaaactattttagtaaaatttaattctctcaattcccgggcgattgcaccaaaaattcgagttccttttggatttccttcttgatcaataacaactgcagcattgtcatcatatcgtattatcatcccgttgtcacgtttgagttctttacaggtccgcacaattacagctctgactacttctgatctttctaggggcatatttggtacggcttctttgatcacagcaacaataacgtcaccaatatgagcatatcgacgattgctagctcctatgattcgaatacacatcaattctcgagccccgctgttatccgctacatttaaatgggtctga

SEQ ID NO: 1849 - DNA, 364 bp, Nicotiana tabacum
tggtgtgaaaagtcagtgattttatcactttcaaccccatatctttgcttataggaccatagaatccagtgatgcaagttagtacttcatgaggatactctaactttaccctatttgtgcatttcccagcatttgcaccatgttttactgaccaaacagattgtccatttcgatcgtactcaatttcgatacagcaaatgccttctgatgattgtgttaggattatctgtttgatcccagtgaaaactccatcatcccatggcttcccaccatctccaccccatggaccaggtccagatggtgctggatctttcactatcctttgcactccctcctcagtgagtcctttctttcccagtttaaa

SEQ ID NO: 1850 - DNA, 507 bp, Nicotiana tabacum
gctttctccgccccatcgacgttaatctacaggttcgcttttctgttcttgaggattgcttaccactagcagaggagacgttcaggcaagcgattaagaagaactatttcacaaggtcaaagtttgattgcctattgtcctctaaacaggtgaaggacctgtgtaagcttttcactgctgcgatgcaaaggttccaggtccaaagacacgcggcttggatttgagacccctgcgatatccaagcgagatagagttaagaggcggggtcgggatggcagaagacgggctgaacgtgctcgacgacctgagcgggttgaagaacgtgggtaccgtgagcgggttgaacgtcctcattttcatgaaagggatttagttacatctccattggtgccattagccccgcttcaacctttaccaccacctgctcctgttcaatcttatgcatatagtaggactttgagaacagatccttatagacgggacacagtgatacagcatgatgatact

SEQ ID NO: 1851 - DNA, 530 bp, Nicotiana tabacum
ttttatagtacacacttttcattataccgaaacattttaaatgtgttacactgccaataagacagaatctgacaagaaataaggatgaaaatttaacaagcagcaatgcttacaacggctaattgcttttacaatgatgcaatgtgcatacagaaactagtgctttacaagaagcccgggccttcaaaatttttaccttctacaacagcttgaccaactcgaaggccgaagcaagagcacaaattgctttcatcttgcctctagttacgcgtcttcacttcgccatccttaactaagacgttatttacatggcaattcactgtagagacatctaaaggaaaaatctcttcgaggtcagaaggaaggtagaggcctctcctagtcacgtgcgagagagacatctaaggacaaaccttttcgaggtcagaagaaaggtagaagcctcaatcagctcagtggaaaacctagtaagggaatcagaatgacacaattgctagccaactagagtaatattaatcggcaaagcatat

SEQ ID NO: 1852 - DNA, 332 bp, Nicotiana tabacum
gtcgtctgtaggcaatagagaggtagagagttttttttatgcaattataaggagtaaagagaattgtaaagtagaatgggagaattgtgagaaatgttagagaataagtgtttgggatacacttgtgtgacattcctcttgaagtgaatttctgatatactttcggtatttttttgggtaaattagagtggagtctctaatttgtattatcgctatacacacttttataatagtagaattcctcctcctttcgcgggcatggacataattggccgaaccacataaatttcggtgtcactatttttctgttgcagttactatcttattttgtt

SEQ ID NO: 1853 - DNA, 576 bp, Nicotiana tabacum
aactagacatacaatggctttgaagaagccaggcgacaaaagaagaagaagaaaatgtttctacttggacaactaagttatcataacttcttcaaattgctgtataaatagaaagtatcatattcagtatgctcttcttgggagtggataggctcgatttacatcgtgccttggatgaagtggagaacgatggtgcaaaggttgctgaccatatctataagcagtctgatgtctggaacttactctaggctccttgggtctttcattgacagcttcaatctgttccagtttctccactacttctttcattgatggtctggttttaggttcaggtccaagacatgacagtgccagttgtgctatttgtactgcagctctggatggatatttcccttccagccgtgaatccatcttgtcctttaacttccttctatcagataaatgtggcttaatccattcaaccagattatgctggtggcttggacggtttgtgtctagtgcccgtagacctgttagcatttccactaaaacaacaccaaaaccatagacatcgctctttacgtataagtgtcctgt

SEQ ID NO: 1854 - DNA, 407 bp, Nicotiana tabacum
agatggcattgttgctctaggagggccatatgtcccgctcaaaacaggaagaagagatggaaggaagagcagagcagacattcttgagcaacacctcccagaccacaatgaaagcatgagtgttgttcttgagaggtttgccaatgttggtatcaacactcctggagttgttgccttgctaggggctcacagtgtgggaagaacacactgtgtgaagttggttcaccgtttgtatccagaagtagaccctcaactcaacccagaccatgttcctcacatgctcaagaaatgtcctgacccaatcccagacccaaaggctgtgcaatatgtgagaaatgacagaggcacaccaatgaagctagacaacaactactacagaaacatattggagaacaagggcttgatgt

SEQ ID NO: 1855 - DNA, 524 bp, Nicotiana tabacum
ttttaattccaaatcataagctagtaaactatatcttactgtagaagcaatattcctggcaatgtcattatcttgtcatacaaatacttaaaaaccaaagataggctcatgctgttaattccttgatgcagctttggtttccaaaacagtgtcaaattactgttgtgcacattgaactctctgggcgccaccatgcatgtcttcgtcttcgttgtatgcctcttgggcttgttgctgcttcctacgcatctcctcttcaatgttaacatcatgcaaagtggtctcctcacactcatccaattccatgtcagtcatttgcgttttgggttttggtggcagcaccgcttcaaggttcttgcactgctcgagggataatgtctctgggaaatctacagtaaagtgaatgtacagttttcctctcataaacggcctttggtacattggcattccttcatcatttatggccttaaattgatcaggcttgacaacttctccaggttgggacttaatgagtagctgtctat

SEQ ID NO: 1856 - DNA, 580 bp, Nicotiana tabacum
gaccaactagacatacaatggctttgaagaagccaggcgacaaaagaagaagaagaaaatgtttctacttggacaactaagttatcataacttcttcaaattgctgtataaatagaaagtatcatattcagtatgctcttcttgggagtggataggctcgatttacatcgtgccttggatgaagtggagaacgatggtgcaaaggttgctgaccatatctataagcagtctgatgtctggaacttactctaggctccttgggtctttcattgacagcttcaatctgttccagtttctccactacttctttcattgatggtctggttttaggttcaggtccaagacatgacagtgccagttgtgctatttgtactgcagctctggatggatatttcccttccagccgtgaatccatcttgtccttcaacttccttctatcagataaatgtggcttaatccattcaaccagatgatgctggtggcttggacggtttgtgtctagtgcccgtagacctgttagcatgtccactaaaacaacaccaaaaccatagacatcgctctttacgtataagtgtcctgt

SEQ ID NO: 1857 - DNA, 500 bp, Nicotiana tabacum
ctatgctctttcattatgcccatattcatcatcttatattgctgtgttttgataatcgtcttcaaggtttatttccctaaaatgaagaatccatttagaaggtctgcgttcgagctatcaattcttcttccattaaggtattttgttttggatggttatgctgctggtatatctagccttcctatcactgcaataaagtattatctcttcgtaccaaatctagataacctggttcatctgtattttggtagaagtggagtccaacagtgaagatagttaatgttttttttaaagaatttggatcttatgggtactctttttattgtaaatactggaagaagtgttgaagagggtatgagagaaagcttcgaagatccttttagtagggcagacacaatgttgggatagtcaagtttctttaatgcatgtaaacattttgcttttcttcaagttttgtggctctgttcaccttctccttgatgaggtagcagagtacttct

SEQ ID NO: 1858 - DNA, 508 bp, Nicotiana tabacum
gaacatttccatcataataggagtactcaatgaagaattatacatagatctccataacacaaggggacatgtctacatcacaaatgtgacgctacagccgaatggagaaacagcactacaatgttctaaaggatgataagtagccaattatatcagattattacagacacggcttgccagtttatttgacagagaagcctagaccacaaccctaaggtacataagtgatttagcgatactgaggagccagttccccatccttgacaatgtaattttgtgctgggaaatcctcgcccttgaagtacctgtccagcatatccttcgttccagcagcataccgcaactgtgcatcaatggtagtccctgaaatgtggggggtcatagcttggtttggcatgtagcgccacggatggtccttgggagctggttgtgggtaccaaacatctccactgtatcctgcaatatgaccactattacaagcatcaacaactgcttgagtgtccatgat

SEQ ID NO: 1859 - DNA, 480 bp, Nicotiana tabacum
tgcaggaatacggcacgaggaaaatagagagaaagaaaagtagaaagatggaaactttcccagtggttaacatggagttgcttaacactgaacaaagggctgcaacaatggagacaataaaggatgcttgtgagaactggggcttctttgaggtggtaaggcatgggatctgtcatgagcttctggacagagtggagaagttgacaaaggggcactacaacaagtgtatggaagaaaggttcaaagaaatggtggcaagtaaagggcttgaagctgttcagactgaaattaaggatttggactgggaaagcactttcttcttgaaacaccttcctctttcaaacatctcacaagttcctgatcttgaagatgaatacaggaaaatcatgaaggagtttgctgataagctagagaaattagcagagcaacttttggagttgctatgtgaaaatctaggactggagcaaggttacctgaaga

SEQ ID NO: 1860 - DNA, 510 bp, Nicotiana tabacum
ttttctataggaatgggatgccaattaacaatgctagtttgactagaactacaaatttaatcctactaaaacaggaatcaaattaccaggaaacaagaaataagaaatcctaaacttcaaggaaaagaaattctaatcttgaatggatttttggacttcttgaatctcttggatttttggccttcttgatcttgcatcaacttgcacacaagttgtcactatataacttgccaatttgaatagaaaaaattcaagacgctttttctaacaaatgtcctcacttgaattttctaatacaatggatcggttcagtctcaatccgctcagtcttaaagctctctaacttcatgggaatgtttcaatctctctagaatcgtgcctcctatgcaaaaactttcttatgaactcctctgtgttgcgcacctgcacatgctccagtgcatctgtactacagttcaatttcagtattatggtagcttactcaacctctaaccgaacttcccatcaaga

SEQ ID NO: 1861 - DNA, 394 bp, Nicotiana tabacum
ccgaattggaattgaagtctccaccaaaccctaactccttaattgtatcagcaccgccctcaactccaccggaatcaccgccgtcgactgccggcagcagaccgatatggctccggcaacggccaaagataagagtaacgactgaatttgacagcgacagctctgtattcttccacaggatttcatgcaaagtgcttgatagttttgcgaaattgaagttatcgtttcagaataacggtaagggagaaatatcggacccgcaattggcgttatctacgaagtatttgtcacttcagtatgacattgaagacaaaaatgctcttgttaacgcttcatttagtatggctcctggttttgcagtttaaagctgctcatgcctgtaaaggcacaacaa

SEQ ID NO: 1862 - DNA, 180 bp, Nicotiana tabacum
tggggctggttgttgctgttgatgataactcacaaacaaggcagcatttcataccacagtatgtattgtcacacagaatgaaacaaagaccatttgttcatgaacattcgcaagttacaacccatacaaatgagtttgagctgtttcagtgttggtgggtaagaccaaactaccatcttc

SEQ ID NO: 1863 - DNA, 315 bp, Nicotiana tabacum
tggggctggttaatgaagaagaactcataaataagcccagcaagcccaccaccaatcaaaggcccagcccagtaaacccagtggttgttccagctccagctcacaactgctggcccgaaagaaactgctgggttcatagacgccccatcaaaggccccaccagccaaaatattggctccaacaatgaaaccaattgcaattggtgcaattgttcccaaactgcccttctttggatccactgcggtagcgtacacggtgtagactaggccaaatgtcattactatttcaggtaccaatgcgtttcctacacccact

SEQ ID NO: 1864 - DNA, 471 bp, Nicotiana tabacum
cagaaacatattggagaacaaggggttgatgttagttgaccaccaactagcaacggacaagaggactaagccttatgtaaagaaaatggcaaagagccaagattatttcttcaaggaatttgcaagagccatcactattctaactgagaacaatcctcttactggaacaaagggtgagatcagaaagcagtgcaatcttgccaaccagccccacttgtccagttcaatcgaattcccgcggccgccatggcggccgggagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcg

SEQ ID NO: 1865 - DNA, 206 bp, Nicotiana tabacum
aaacactttggccacctttatttcctaagatcccttccattttatttatttttcttctcttcccattcttagtttcaactttattctttcaatttccaatggccagcgttgaggttgaatctgcaccagtagcagcagtagagactactccagctgaggttgaggttcaaacaaccctagaggaaaccaaagtagaggaaccagcc

SEQ ID NO: 1866 - DNA, 228 bp, Nicotiana tabacum
  modified_base (93)..(94): a, c, g or t
  modified_base (116)..(116): a, c, g or t
  modified_base (172)..(172): a, c, g or t
  modified_base (177)..(177): a, c, g or t
gggctggttgatgttgtaattattatagtagcagaacttggtttccatgctattacaccgcggacatggaagtatgttgtctggtttttgtcnntgccttctcctgagtgacattnggcctcatctcgggtcttctttcttggtagcttttggggaccatgtttctttatcnggcantcctccttctctgggatcatcacttataccagatgatgtttctgtttcaac

SEQ ID NO: 1867 - DNA, 222 bp, Nicotiana tabacum
ggggctggttcattagttggagctttttcctggctgcgagtaggttgagaattgttaccaggctctccacttccaaacaggtatcccaaagaactctggccacctccagcacttactccgcgacccatctttaatcgactgatttctcaacaaaaaaccccaagtactttgttatcaatgccgaatcatgttacatgaagcgagagacggagagaggaaccg

SEQ ID NO: 1868 - DNA, 389 bp, Nicotiana tabacum
gctggtttaagcttcgttaaatttccaacctttgaacaacgaggttttccagtacaccaaccccccggtgtgaagcttccattgcttcgatggaggagttcttcatcaatcttgtccaaaacgggatcatcttgcttgaacttgcgtgcaaaagcagcatcacttccaatcatttttgctgtgtcattaatgttgagagtgtgtggatgctgtcgtggagggtaatcccaagaaatatagtgcatgtcgtggttaataacagtcgtagcaaattctggggcattgcacacaacggtctgaaagtatccttcaggagaagagacaaaatttgtgtagtacataagtagggtcctaggaagattatcccaaccccatatgcagtactccac

SEQ ID NO: 1869 - DNA, 489 bp, Nicotiana tabacum
gttctctgtgggaaccaggtcacagaaattggctaactcctgacagaggtggaagacgtgagagggatcggcactctgttaacatttctactgaatcacttggtatggcaagtgaacgaaaccgaggaccaagggcattaaaaccaaagagcaagggtcccattgaggatagctcttcatctgtcatccgtaaagaagttgagtcgactaatactttgcagcctgagcagtataatcggcctgaatttgtcactggttatgaacatgccaagttctttgtcatcaaatccttcagtgaagataatgttcacaaaagcatcaaatatagtgtgtgggctagcactcctctgggaaatggaaagcttgatgctgcttatcgtgaagcaaaagagaggaatgctgattgtcctgtttttctctttttctcggtgaatgctagtggacaattttgtggggttgctgagatggttgggcctgttgattttgaga

SEQ ID NO: 1870 - DNA, 481 bp, Nicotiana tabacum
agttctaatacaatatgcaagttgaaactgtaagcattcacaaacaaaacaaaggactgaacaacagaaaagttacagagagtaaatagcagagagaaaataggcataaatggcgttgcaatcatccgagaagatgaaatgtagaacacttttgagaaaggtggaaaagaaaagcaagatggtgcggtggttatcataccagatatttacgcaatttacgcgatgtgatctattttgaacttctgaaaatagaggcaccattcatattttctaaatcttaagagaagacgacgaatgggatataacaacccaagtctctatttacaaaaaagcaacaaattgggtcctttaagatatgagatgaaccttacctgaaaggctgaaacctcctcaaaatctgtgataaacatttttgtcatgtttgagtcttctcagtgaagtcccgaagtctattcaacaaaagctaactacaaatccatat

SEQ ID NO: 1871 - DNA, 220 bp, Nicotiana tabacum
ggacactaccacaacaattggtgcatatttgattatttttctcttcttctgaacgtggacaaactccataggcaattcttggatcacaatttcggggacaagcttttggatttctaggatcagactgtcctttacaaacaaaagttccattagcactgaagtagttacaacccttcgtgcctgcgcaacagttggtgcatatttgattgtcctccttttc

SEQ ID NO: 1872 - DNA, 386 bp, Nicotiana tabacum
ataatttattgatgtttctatttgtccattactatacttctcagttgtccaaagtagctaataatggcggtggaactaatgatggattacagaaacactaggaattgtactttggtgaccaaattggaagaaaaaacagttgtagaagaagcatcttctggtcttgaaagtgttgagaaactcatcagattgttatctcagactcagactcagactcagtctcaacaaatacagcagcaaaaacagggatatttagagcaaaagaactcccctatggaaattgaaatggtggctgatgctgctgttacaaagttcaaaaaggtaatctcacttttagatcgaaacagaactggccatgctagattcagaagagcccctgtggcttc

SEQ ID NO: 1873 - DNA, 96 bp, Nicotiana tabacum
gcaaaatgaccagagtgacagatattatggtagaggacccatccaattgacaaaccgaaataactatgagaaagctagaactgcaaaatgggaatg

SEQ ID NO: 1874 - DNA, 515 bp, Nicotiana tabacum
gcagttctagcaaaacacgtgaccacaaggtgtggctgttggatcttggcggctgcttaggcaaagcgtgcatttgcttggactgcttccttgtgactccgaggttgacgtggattcaaccagcccagacttcccagtttcagcagtaattagattgccttcctcatttaaaacaggtaaacctcggcctgtggaagtctgataggttccaaagggtgcttgttgaacagaagctgaaatggatgataaactactacgcctcagaccttcagccgcaagaatacataattgaattagaaggaagacccctagtatttgatatctaggtcgttggttcataggtttgccaatgaacacatagcgaatgcccgcagtacgttttgatatatgataataaaatccttcaaaatagaagaacatgagattggtccggatgaccaattgcaagacctcacgagcaagaggaagcaccgaaggccaccttcgaactgcatacaaccagaaatcccttatct

SEQ ID NO: 1875 - DNA, 202 bp, Nicotiana tabacum
gttctcgggtgcgtcgtggagaataaggtgctacacaaatccctgttgttgtgcatacaggatacagattttcagaagacaatatactcttccaggttaagttcaataaccttcccctcaaagtcttcaatgccaagttccagtggcacatcatcatccgcttgtggaagttcagcaaggttagaactgcaaaatgggaatg

SEQ ID NO: 1876 - DNA, 477 bp, Nicotiana tabacum
gttcaattgcagtaagctagccatggggagaagacctgcaagatgttaccgccagattaagaacaagccttacccaaaatcacggttttgccgtggtgtccctgatccaaagattaggatctatgatgtgggcatgaagaaaaagggagttgatgagtttcctttctgtgtgcatttggtcagttgggagaaggagaatgtctctagtgaggcacttgaagctgcccgtattgcgtgcaacaagtacatgaccaagtctgctgggaaggatgccttccaccttagggtcagggttcatcctttccatgttttgcgtactaacaagatgttgtcatgtgctggagctgataggctccaaactggcatgaggggagcttttggtaagccacagggtgtttgtgctcgtgttgcaattggtcaggttcttctctctgttcgctgcaaagatggaaacagtaaccatgcacaagaaatctc

SEQ ID NO: 1877 - DNA, 488 bp, Nicotiana tabacum
aaaagtttgatctcttctcttctccccttaattctttctcctctactccattgctaagaaaccaatttttcttcttcttttttcgtccatcgtgtaagaaccagtgcagcttcgtcgcacctctattcatagccgtgtgatcttcacaaccgtgactacaactttattcacgttagttccacccagaaccaccagccttgaaccaaatcctccatagccaccaaactccaaaacaaactcagttcaaacaatactacctaaaaattctataaaacaccaagatccaaggggttttgttgggttctgagttcgtgttcgagttacagtccttgttcgagtttccggcgccgctgaagttttccggtctaaggctcttgtcggtgcctatttcttggtccagcttgggttctggaaaattgctctactagaatcagatttcaatggagctcacaattgcattaacatttggaatgtattatttgctatag

SEQ ID NO: 1878 - DNA, 381 bp, Nicotiana tabacum
ccaaccagtaagactcagacaataaaagagaccattgcagaaaactaacttattccaaatgctgctaacaaatggcaaacgattttggtaattggcagttgtccattccgttgcccccggttgacatgtgctaattgcgaccaaagtggggctgatatgcttaactgtgaaaacgatacagttcggagatgtaggagctgcagaaaaagcaactatctggtatgttaattctagtcttggtaaattgatcacgttcttcgtataaggattgaagaacaacacacgtaaagttctcggtttgtatagcagcaaccagccatctttcgcgtaacaaagcctagagccacgtaactctggtaactcaactgaataagtttgcct

SEQ ID NO: 1879 - DNA, 472 bp, Nicotiana tabacum
gttcttgcgagcctgaagattttgctaatggcaaaccaattgtgccttgtggattaatagcgtggagtttatttaacgatacttatacatttgctagtaacaatcaagaattggttgtgaataaaaagggtatatcttggaaaagtgatagggatcataagtatgggaaagatgttttcccttcgaattttcagaatgggactttagtcggaggtgggagtctgaattaataatgtaaaatcactagtgaattcgcggccgcctgcaggtcgaccatatgggagagctcccaacgcgttggatgcatagcttgagtattctatagtgtcacctaaatagcttggcgtaatccatggtcatagctgtttcctgtgtgaaattgttatccgctcacaattccacacaacatacgagccggaagcataaagtgtaaagcctggggtgcctaatgagtgagctaactcacattaat

SEQ ID NO: 1880 - DNA, 505 bp, Nicotiana tabacum
agactcccatagtacttcaacattatccttggagtatgaattacatgttccccagctgaaacggaccaaagttgggaaaccaaaaactacgtgtttgtgatgatccagccaagcttttgtctcaggatctccaggatatccagatccaaagttcttatgcatgttctcagcagtttcatcaagcacccaatcccgcaacgctcggtccctagtaacctttgcaacaatactggctccacttacgacggggtaaagactgtcagctttttttgcaacaacaaatttgattgttggaaatatttcagagagcttcactctgtacttttcaggatcaccaacagtatccacataaacctcagttaaaagaacaccaaggtccagtgccttccttacaaggcctatcgcagaattatgtgatatttcattaagatttattttggttttctttaacatcttggctgagagatctcttggatctatcacatcaaccgcccatccgatggat

SEQ ID NO: 1881 - DNA, 529 bp, Nicotiana tabacum
ttttaaacctaatgtactcccaaagggggaagaaatatattattcgtagaaaaataaaattggggaacacgatttattatttattttatttatgtcatagttcacatatctgtcaccttattataagtaggatacttgacaaacacaattacgtaatccatcacttcatctcttgaaatgacactccccatgtttgtgaagctgtacgagaaagtccccaattttgatcccctgcaacgtgccatgcaaaataaccaagcaatcctctacctttaacataattaaccttatttctaacagtttgagtatcatcatagctaatccaattactaccagagtaacaataatctccaacaatggtagcgttatacacagtcgtggcgcgactctccactatataatccctaattctgttataagtcatcgacccatcatcgaccgcaccaacatttgattttccggcagcaggtgctctaagaccgtgaatattcgcgttaactaatcgccacgcatagccataaaatggaat

SEQ ID NO: 1882 - DNA, 587 bp, Nicotiana tabacum
gactcccaaccaaccagtaagactcagacaataaaagagaccattgcagaaaactaacttattccaaatgctgctaacaaatggcaaacgattttggtaattggcagttgtccattccgttgcccccggttgacatgtgctaattgcgaccaaagtggggctgatatgcttaactgtgaaaacgatacagttcggagatgtaggagctgcagaaaaagcaactatctggtatgttaattctagtcttggtaaattgatcacgttcttcgtataaggattgaagaacaacacacgtaaagttctcggtttgtatagcagcaaccagccatctttcgcgtaacaaagcctagagccacgtaactctggtaactcaactgaataagtttgcctcactgaagggtcgtagaattcaaccaagtcaccgaattttgggaaaaacataagccaaggtggtttattcgcaactcgtacagagacggaaacagcaagccattgcttgcaaacagcagaggcacggatgttttctctcaagtttaaccgggagagaatcagttcaagaatttccattggtacacaaaacaatgagt

SEQ ID NO: 1883 - DNA, 428 bp, Nicotiana tabacum
ctctaattaaactcttccgttcatttttcttgaattattcgcaaacatatagtcgaccccaacttgtttgagattgggacgtagttactgaaaagtcaactcaaattatgagttcaaacaatccatcgtctagcactggagtttttggatcggatgaacatacaacaataagaagaaattcaaagcgaccaaagtattcaaaattctcacaacaagaacttccagcatgtaaaccaatcctaacaccaaaatgggtgatttctattcttttacttattggtgttgtttttattccaattggtattgtttcccttttagcttctcgagatgttgttgaaattattgataggtatgatgttgaatgtgtaccaaataattcaacaaatgataaagttggctatataacaaataaaaatcaagataaaact

SEQ ID NO: 1884 - DNA, 469 bp, Nicotiana tabacum
gagcagtacgcaccccagattattcacgtgcatccaaacaagacttataggcttagagtggctagcagcactgcattgtcttcactcaacttggccattgggggtcacaaaatggtggtggttgaagcagatggaaactacattcaaccattttctgtagaaaatatggatatttattcaggtgaaagctattcaattctcttcacaactgatcaaaacccttcaaacaattactggatttcagtcaatgtaagagcaagagaacctaaaacatctcaaggcctcactatattgaattacattccaaattttggttcaaaaattccaatttcaccaccaccattgccacctctttggaatgattataactacagcaaagtcttctataagaaaatctttggcttgattggatcacctaagcctccaactcaatacaatcgtcgttttttgctcctcaatactcaaaaca

SEQ ID NO: 1885 - DNA, 168 bp, Nicotiana tabacum
cagactcccaccagtcactagctgtacagccagtctacctagtttctcagcaagcacgacataaggagccaactcggacaatacctcaggagggaccattggagcattcacagcggtagcagaaagttccccatttagagcaccaacaacagcctcagctatttcaat

SEQ ID NO: 1886 - DNA, 438 bp, Nicotiana tabacum
ctcatttcacctttgcttttcttgtcatcagatctacacatctttatactctctctatttatagttgacccttcgctggaagagctttttgctggccattttctctcacaggagggaaggccatgtgagttgttgcaagcggacaagtatagacatcattttgttgggttttcagtgagcttagtagtttggttagttgctgccagatgggtaaatgtcagggttgcgggaaactaggaagaatggtgagtgacgggcctatgagtgcttaccaatcttctcttcttcaatctcctgttgtttctgtctgggactgtattgttcgtaaaatgaggtattcctttagacctgagtttgtgtaggtgtacttttagtaaacgctttagattggatagcatttagtcttttgcaatagtattaataacagggcacaaagga

SEQ ID NO: 1887 - DNA, 554 bp, Nicotiana tabacum
gactcccaggtgcatgcttataaagccccctcattcactcattttcgtcatcatcatcttaaagttgagctggtgcactccctctgataaaggtacctcggcgatcacccccaacaatcacatctttcagtcgagatagtggaccaaacatcctgccaatcctctccccatggacaacctgccacttcgtttgcaacacctgccacctttcttgctgccacgtctgcccaataatcacaaggcccataacagcagcagcaatgaaaatagaccagaatgcatttgcgtctttcgcatgggccacaagggaagcagcccctcttttccaccatgcttgacaaggaaggttagctgtatcatcatcatcttcatctttagactttggcaaatttgagatgcctgagtctaagccctggtaaaagagttcaactggttctgcatgcacattggtttcctctgttgttgctgagagatccatgggttcttcactctggcatgaactatagttagcagtaccaaggaaactctgctctttgtctaccaaacttaagcct

SEQ ID NO: 1888 - DNA, 537 bp, Nicotiana tabacum
tcccacattgcaagtcttttctgtcgtgcttctgtttgatacttctccaattcatccagagcctgttgtttgtccttgggctcccacctcctccttttctccatcctagcaagtccttccttaagcaaggtagcatttatgctgacatcagtttcaggatcaaccaaagtcaccaaaaagattgtccctgttccttgacctttgacttttccacctgaagcgtctttttcctcgatagcagctctgaattcctttggcccacttagaagaagctcacttagccggtaagctgcttcctgaccataatcatcctctagcccaggaactttaacatgagcaagactgcagagctgagctagaccaggactggaggaaacagatgcctctagaggccgcaactgactgtaagaaacaacttcttggtttccataatcaatgtagaaaacttcaaacttgtctttggaagattccacagcaccacgaggggcattgacaatcattgctcggttccatgaattatcagcactgaattgagca

SEQ ID NO: 1889 - DNA, 379 bp, Nicotiana tabacum
ggaaaatattgataaacccaataacgttaagattcagaagtatcatcatcatcattgatttaaatgaaaacagaaactccaacaaaattcaatgtttcaaaagcactaaaaactctctttagctaaaatagcaataccagacagaaagatacgactgaaaaaatcaatcgacggtctgcatgatatcctcagcagtgaacttagtacccttgtccttatcagcagcagcgcgtcccttggccttacgattaagtagcgatttcctgtccttgtcaagcctgagtttcgtaacaacaaccttagaaggatgaataccaacgttaacagtagatccattgaccttctctctagttatacgttcaatgtgaatcacccattt

SEQ ID NO: 1890 - DNA, 366 bp, Nicotiana tabacum
ttttagttcaagagttcatgtcattgacatccaacaacaaaaatggcagagctaattacgccccgacacaggaaatattggaccactcaacaagcacaagtgtttaaattcacaacatagactccacttgtatataactattaagttcaatatccccataggagatttatttagtgctcgaattgcaacattcaacaagctgagcgaagcgcacacttcaggaaccacacaaccgccatatggtaacatttattacagcctataaggatttcaacttcttcgcctctagtaaatttaagcagcagcattaactgcacagccagcgccttctgcatggacaaacgattcaatatattctttccttgc

SEQ ID NO: 1891 - DNA, 430 bp, Nicotiana tabacum
ttttgatgaacaagcagcacagctcttgaaattcctgttataaatccactgtcacaagtgttgtagaaacagtaaacttacaaaagcactaagacatacttgaatggccactaaaaaaaagaaaaaggccttatttttagaagtttcagcaaaccggaaaggaaaaggttcagacaagaacattctgctttgatcggaaaaccctctcgagactatggtatggtagtcgaaggacaaaatgttcaaggctccacggtcatgttctctgcttcccgtctaacagattcaaagagcacagaggaaagatatcgctccccgaagcttgggaaaacaacaacaatgagcttcccagcattttcagggcgcttagcaagtttgatcgctgcagcagcagaagcaccagatgatatgcccacaagcaaaccttccc

SEQ ID NO: 1892 - DNA, 445 bp, Nicotiana tabacum
ggctgcagtaagggaggaaattccacctgctttaagagctgctgttgatcctgcctttttggttctggactcactcaagggtttctacccgtctgaagtgtcaatttcagatgctaaaaaagatgcaaatctcttaggtcttcgccgaacttgtattatgctgatggaatcccttagcattttattaaagaccctggaagtagattctatttcaagtttaatatcaggaagcgtaaaggaacgtgcaaaagcgattgctaatgaatggaaaccaaagttagatgagcttgatgctgatgccagtaatgggaattccttggaggctcatgcattcttacagcttttagctacctttgacattaactccaactttaaccaggaggacctgtacaagctgatacccatggtttctcgtcgtcgccaaacagctgatctctgtcgttcc

SEQ ID NO: 1893 - DNA, 445 bp, Nicotiana tabacum
ttttcaggtaaactggcaaacaaagtaaaattacatgaagtttctcccttactaatagtcatcaaatagatattcacaaattgaaaagacatgtctcttgacaacccactttaagggagattaagaagtaaactaagttctttcgccgaatttattcattcaccaccagcacaataagacattgctgttacaaagtctcagacatgcctggtgacgcctttgccattatcccatagcatatttctgagtccagctacgagcagtggtctcgtatttggacctgtcggtcttgtacatgtgagcaatttctggtacaagcggatcatctggatttgggtcagtcaatagggagcagatggagagcaggaccttagatatggttaacgctggactccactgctcttttagaatatccagacaaatacttccattgctattgatatta

SEQ ID NO: 1894 - DNA, 376 bp, Nicotiana tabacum
aaacctcggtatagatcttccacctgaaaaggtgttcttgttccagaaggctgctgttcacaagtgtaacatggctggcaagccagctgtagtaacacgtgttgtcgatagtatgaccgacaatcttaggcctactcgtgctgaagcaacagatgttgctaatgctgtcttggatggaactgatgctattcttcttggtgctgagactctgcgtggattataccctgtcgagactatttccactgttggcagaatttgcttcgaggcggagaaggttttcaaccaagacttgtactttaagaaaacagtcaaatttgttggagagcccatgacgcacctggaatccattgcctcatcagcggtaagagccgccatt

SEQ ID NO: 1895 - DNA, 510 bp, Nicotiana tabacum
ttttgaggaaaacgaacgctccattcatgtatacactaatgaattaatttctgttagaaaagtcatttttccctaccagcccgcaattctccaatccaggtctaaattacaaaaagcatcttcaaacccaatttgcaaagtgtaaacaacacaccaacaatttgacaaggaatgaagacaggtaaccagcacaatcatcatcgacaataccaactataaccttgattccctccaaccaaatatctagggtcaatttacagaaactgaagccagtgcctctgggtctacttatataatgagctcatcgaatttgtggaacttcatcgacaggaggagcagcaaagcgcacattagctggccgagccaccactaccggctcgtcagcaaacattgctttgataaatgctggtgttttcaggggtctacgaccagtcattcgtggatagacgtcttccaggaaataataagcatggcctgcaatcattcccagtaaatccacccaagcactag

SEQ ID NO: 1896 - DNA, 487 bp, Nicotiana tabacum
ttttagaactaaatcttttgaccaaagtcaaaatgttaataacttgaatacttcaaaacaagagtgcctacaagctacgagagtactgccaactaagacgttaacccctaaacaaatcttattaagatcgacccaacaaatagaactataactaacccaacccaacaaaactacataacattatcatatattaacaggaaacatatcatgtgaatgcaccccactaaactgcatggattggactgtggctagagttcatgcctgagctaccagatgaaggattagcatggaaagctgactgcctggaggagccctcaaccagttttagtgagagagaagatggtttggcatcaccaatggattctcctaaacttagctttgacataccaaccagctcatcaacattaattggactctttgaatgaacagctgttggcttaagaacttcatgggtctctgcttttgccggctctgcagtataacctgg

SEQ ID NO: 1897 - DNA, 448 bp, Nicotiana tabacum
cacacactctcttcaacttcttccatttgggtctctctctttctctctctacattcacaaaaacccatctttttctctctctcttttttcttgtattcatatgtatgacgaattcttaagaaagacaacgacttagctagtaaaataaaaagataagatgaggatgttaatggccattgattcatctctatatggtttcttagttattgcagcttaccccaaagggtattcttccaaaattacttcagatttagtccttttcttgggccttggcttcattgattggtaatttttcatctaccccacctccactatatttacacttatatttaaaataaaataaaaattatactaaagatttaatttttatatgtctttctaaagcttatgcactttgttgattctgtctcattcttttgttgcataataattagggctttgtgaatct

SEQ ID NO: 1898 - DNA, 472 bp, Nicotiana tabacum
ttttaaaaaacagacaaaagaacgccgaattctagtcataccagctgttgagaatttctatgtttacatatttaacatatcatcattcatcaatcaacttcctttaaaatttatacatttttgcttcttttttttttggtaggaacatattttgcttcacttctatgtagaaaaagaaaattacaactagcttagcctgaagaatcagtgcccaaaacatggagagaaatatcctctctttaatttgtatatttttcgtcatcattattcaataatacttcggcgaaattcctggctatttatttctacgaggttaagtgaccaacgtcttcccatttctttacatgcgtagaggccttctctgcctctttattccaatcacatcttattgtgattatagccaaaatcaaagtctgaattgcagttccaccaaagatcattccagcccagatgcccatgacaccatagtgga

SEQ ID NO: 1899 - DNA, 445 bp, Nicotiana tabacum
ggaaggctgagcatttgtgaaaagggacaaaaagagaaacaaatcgatcgattggaaatggcggaagtgaatggactgaaactggagcagaggcatggaaaatccagagtgagagtagccagggtttggaaaagtcatgacgggaagtatcactttgctgaatggagtgttaacattagcctcctctccgattgtttacctgcctatgtcgccggtgataattccgatatcgtcgccaccgataccatgaaaaatactgtgtatgccaaagctaaggaatgttcagagcaactttcagctgaagattttgccattatacttgcgaagcacttcacctctttttatcagcaggtcactgctgcaattgttgatatagttgaaaagccatgggaacgcattagcataaagggccaacatcatgaacacggttttaagcttggctctg

SEQ ID NO: 1900 - DNA, 426 bp, Nicotiana tabacum
gttggttaatgagtcagaacttgtaagtgatcttgtttccaccggaatgaatggtgtggttgtgggtgctgaagattataaaagaaaattaccaccatccccccttgagagttcaaatgagatgaagataagtaggccaaatgtctttggttttgattctgtgccgctttgggggctcaccacgatacaaggaaagaggccggagatggaagatgcagcagtagctttaccaaggtttctgagaatcccatctcaaatgttgatggatccgccagcttctcatgccctgaatcaaacactaacggcccatttatttggggtttacgatggacatggaggctctcaggttgctaattattgcccgtgagcgtatccatatggcctttagcacaggagatagatattgcgaaagaggattcacataat

SEQ ID NO: 1901 - DNA, 421 bp, Nicotiana tabacum
tgaatctagcacaaaagactggcagttcatcggtgaaaaagcacgaaagaagagacgattttccttctttcattagaagaaccagtcttgggtggatccatatcgtgattctttaaactaaaataaggtccagcgagcacaaaatttggcagaccacaatagtgagagagggcacctcccatccttcaacattcctctaccatgttttagtcaggtctctcgctcccccctagtcagtaatttgacgcatgtaacgagcaaatagataaatttgagtgatcatctcattaggaagaattttcagcattattcagatgcaggtcttctcaatacgcctgtttttttctttggtttgcgctttttctgtttctccttgagtcttacaaagtccttggcgctcttttcccattccttcctgcgc

SEQ ID NO: 1902 - DNA, 409 bp, Nicotiana tabacum
gtttgcactggtatttgggtcattgcgcacgaatgtggccaccatgcctttagtgactaccagtgggtcgatgacactgtcggacttatcctccactctgctctgatggtgccttacttctcttggaaatatagtcatcgtcgccaccactccaacactggctcgctcgagcgtgatgaggtctttgtgcctaagccgaaatcacaactcggatggtattcgaagtacttgaacaatccaccaggccgggttatgtcacttacagtcaccctcactcttggctggccattgtacttggctttcaatgtctctggccgacattatgatcgcttcgcatgtcattatgacccttacggcccaatctacaatgaccgcgagaggctacagatcttcctttctgatgctggag

SEQ ID NO: 1903 - DNA, 425 bp, Nicotiana tabacum
ttttcaaaccaaataagtttaaactgctaaatttcatcattcagcaaacacttgcacttaataagaaactaagatttataccacattgattcataattgaattataaactgatgtcaatagccatacaatgaatcctccaggaattcacgagctatgctttctggtctttcaaatcagttcagacgtgaaccgccaaaacaaggcgtgagaaatcagtcttttctgagctccatttcttccctacgaataccattcgcgtttaatatgactatctccagcctgtcaccggtgtatatatccctttcagttgctgaagcaaaacatgttttcactaaatcaatggcttctgattcagaaagcggagtaacagcatccttggcaggcagcaagagagggctgggagattttagctggttgtccagga

SEQ ID NO: 1904 - DNA, 507 bp, Nicotiana tabacum
ggagagaactcagctgcctgccctcttctctctatactcgggcgattttcggccaccacgctgccgtcaaatttcatcaccgacggccagcgactcctccttccccgcttcctgtttccccgcttctctttatctttttctctactcgcttaggttctgccgtcaatcatcaccggtcgttgccgctggaggtggtgaccagccaggcggcgaccactgtttctctcacctccctgtcaaacgccggtgaccccattaaaactggtcgatttgaagtttgaggcttaagatgtgtgcagatctggccggatttattccatctccgacgactcgtgttccttatcattttcttgtgcttattcgatggttattagctcagatccggtttcgttttggagaaatatggatagaacagatttttcggcgaccttcgtgtactgttgtagaccgttttgttttactggactggtcatcttcattttaaatctgctatagctttgatgtttt

SEQ ID NO: 1905 - DNA, 403 bp, Nicotiana tabacum
cttcattcttcaaatttctgataactcgaaaaaaaacacttcaaactttgccaaaatggttcatgaaaagcaagtgatagaggaagtatccggctggcttagagttttcgaagacggttcagtagaccggacttggaccggtccacccgaagtcaaattcatggccgagccattcccaccgcacgacgactacatcgacggcgttgccgtcaaagatgtagtcgccgacgaaaactccggcagccgtctccgcatctacttacctgaacgaaaagacaattccgtcaataagcttcccgtcattcttcacttccacggcggcggcttttgcgtcagccaagctgattggtttatgtactacactgtctacacgcgcctagccacgcgtggccaacgcaatcat

SEQ ID NO: 1906 - DNA, 557 bp, Nicotiana tabacum
ttttgctaaaacacaatcataatataaattttattaccaaaaaatggtatgttgctatctgttggcaaaagattgccattttcagtgcttcccgaagtaaataaacaacactttgcccgacaacagggacataaaaagttttaaaatcctttattcccttctcaagattctctaatgagaagctctctttctgctgtcatcttcccgcaattaagcagctcgtaaaggtggccaaataatcaaagcggtcccttattgcttagtcaactgacgaatgacatatggcagaatacctccatggttgaaataagccaactccacctcggtgtcgaaccgcactatgcaagtgaaggattttccagtatctgttcgtacagcaacgtcttgacctgggcggatctcactaatattttctggaagatcaatggtatatcgctcgtgacctgtcaatccaagtgtatctgcatcctccccagccttaaaacatagaggcacgatacccattcctaccaagttgctgcggtgaatcctctcgaagctcttagcaattacagctt

SEQ ID NO: 1907 - DNA, 361 bp, Nicotiana tabacum
cctcgtgccgaattcggcacgaggcgcaaactggtgaaggcattgctgaatgtgaacttctcaaatggtttgttcaggagggggaccaggttgaagaatttcaacctctttgtgaagttcagagtgacaaggcaacaattgaaataacaagtcgttacaaaggaaaaatttctcatattgttcatgttcccggcagcattgtaaaggttggggaaacacttttgaagattgccgttgatgaaattcctgagcctactgagacttctgatgcttcagaaaagatgacatcactggactctgattttattggctcaagtgatatcagctccgtgcctgaaaaatccaagattgatggagtgtc

SEQ ID NO: 1908 - DNA, 433 bp, Nicotiana tabacum
aaaagaacagacctatacaatcagagataggagtaacgcctaaaacctagagccctagggaaatgcaccgctgatcaacaatagagacccccccctctctaaggtcttcttcttcagagactggaagagaccttcctcacagactttaagagacctgaagattttagatcagtggcaatacacaaggaccccccctacatcgccttcttctccaagaacaccaccccctgaagatcgtcttcctagtcagccccaccaaaaccggcgacccttcatctcctccaccaagctcgctggaagtccgacatcgatctttatcagaaacacacacacacacacacacacacacgaaagcatacagagatacacaactgtttcagtttccgttatgatgatttcgatttttagatttgttaatggagttctattaaat

SEQ ID NO: 1909 - DNA, 478 bp, Nicotiana tabacum
ttttgcagcaatcgattagtatgtattcatttcagtaaaatctttacattttaacaacctttagtcataatcacaacaacaatggttttttccgttgagaaaaattcaatcagttattacaacaaccaacaatctttaagctgtccaagagcactgtccctaaaattctgtactcttgctaaacagaaatgagtgcaaaacaatcccattcctaaaccagcaccaactctactcgtcttcaacaaataacaagctggtgaacattctacccctttcccttgtactactactccccatgcttttgttatacctgattcctctgattcctctgcaattttcccatttttcaattcttcttcagtcccaagttcttcaataaaaataagcccatctggggatctttttgctccactttcccattcactttttaccaccggccaatcttccacaacggctctctctgtcttgatcttgactt

SEQ ID NO: 1910 - DNA, 479 bp, Nicotiana tabacum
gctaagccaagtcaacaacctcaaccgttcataatctacttaccccatttcattttttcctccaaatttcacctgaaaaaaaaaatggtggagctaaagaacctccgatcaaacacattaacacttgtacttgtaaatcttgctagtataatggagaaagctgatgaatctttattacctggagtttacaacgaagttggcaaagatttacatactgacccaactggtcttggttctttaactcttttcagatcattagttcagtgtctttgttatcctttagctgcatatcttgctgctcgttacaacagagctcatgttattgctattggtgcttttctttggtctgctgctactttcctttgtgctatctcctctacttttactcaggttaataatttaattctctatatatgctgttcaaattgagaaatgagtcataacccagttgataatttacgaaattagtgttgttttgg

SEQ ID NO: 1911 - DNA, 515 bp, Nicotiana tabacum
ggaaaatggagttttctggatcaccactgacattgttttgttgtgtgtttttcctgttcctaacagggagcttggcacaaggcattggctcaattgtaacgaatgacttgttcaacgagatgctgaagaataggaacgacggtagatgtcctgccaatggcttctatacttatgatgcattcatagctgctgccaattcctttcctggttttggaactagtggtgatgatactgcccgtaggaaagaaattgctgcctttttcggtcaaacttctcatgaaactacaggtggttccctgagtgcagaaccttttacaggaggatattgctttgttaggcaaaatgaccagagtgacagatattatggtagaggacccatccaattgacaaaccaaaataactatgagaaagctggaaatgcaattagacaagacctagttaacaaccagatttagtagctacagatgctactatatcattccaaacagctatatggttctggatgacaccacaag

SEQ ID NO: 1912 - DNA, 319 bp, Nicotiana tabacum
tcttcgtcgagagggagggcacgcaacagcatcagccatggttctcaagacagaactctgtcatttcagtggcggcaagatttaccccgggaggggcatcagatttattcgttcagattctcaggtgttcctattcctcaattcaaaatgcaaaagatacttccacaacaggctgaagccatcaaaacttacttggacagctatgtataggaagcaacacaagaaggatattgcacaagaagctgttaagaagaggcgacgtgccaccaagaagccttactctaggtccattgtgggtgcaaccttggaggttatccag

SEQ ID NO: 1913 - DNA, 286 bp, Nicotiana tabacum
gtgatcggccggatttgatctgacgccgaccggtgttttgccgacgttgatcaaattgtattcctgatgcagatgccgccgcgctccaagataaagcagccccaagaacactggtagccggtgccaaagattcagcttatccacgaaatgaacaatcagaaaaaaaagcttgtccaagagagtcattctctcaaagatatcatggaaatctttgtggatgaaaccacgaagaggggagagcaaaagattcttaagggatgccataaccaaagacattgttttttct

SEQ ID NO: 1914 - DNA, 140 bp, Nicotiana tabacum
ctctataatatatttgttctgcttttccttctctaagaagctctcttttctcgctcgtttgattcccaacaaccttttcaagatgcaaatctttgtaaagaccctcactggcaaaaccatcaccctcaatattgggtctc

SEQ ID NO: 1915 - DNA, 337 bp, Nicotiana tabacum
ttttgaaaccaaagcaacaaacaagatattaccaatgaactatctaatttctccttttcttttaccctttggatgggcaagggactatagctgtatacaacagtagcccagaagttaaaacatataaactgaaaggagtctagatgctagtaaaagcatacgacacatttgtttgtcttaacaacacagaatataaactgccagctagaagttatagtaactaagtggccagcacaaaatacacaagaatctaaagccatcacttggcaagcatcatgcgaacaaactcctcgtaattaacttgcccatcaccctcaatattgggtctcgtaccgcc

SEQ ID NO: 1916 - DNA, 445 bp, Nicotiana tabacum
gagggtgatatcatggacttcaagaaacacttgaaaaagagggctggactgggcgagtgaatccgatattctttgtgtgttatagtagaatgtgatggtatttcattatttcctcttggtcgttgttcagtgccaagggtaatgtgaaatatcatcaggaccgtcaaggaagctgacggagagaaagcaaaagtttcttgatcaccagtaagacgtagtaatgtttagcaaagaccacgccgagagctggtgctagagagaggaagtgatcgaaccttggtcaccatatgaatctctggatatttttttggcttagttcactatttgtattgtctactttactgtctttacatactcttaggttttggagaggattaatgacagcgtatttcttatgttagcatcatgtttgttatctattgctatattattgtacttcaaattt

SEQ ID NO: 1917 - DNA, 299 bp, Nicotiana tabacum
ccaaaacaagcgcccgtcgccaaccagaacgaagctctattccctaaatccccagaaatggaaactgctacagctttcgggtcttctttcagcatctgttacagacccaccaaggcgtctcttggtgggtcggattttgttcgattcgggtcacagtttcggaattctccctctggaatcaagctttatccctcaatttctcatgtgaagttgagtaacaagaaagcggcttttggtagcagaaaatgtacctcaatcagggcatctctatcaccctcaatattgggtctcgtaccgcc

SEQ ID NO: 1918 - DNA, 179 bp, Nicotiana tabacum
cagaaacttcctcagagcaatcttccggaaacttctgagccttcaatgctcctctctgagaaggctagaagtgctctttatgctgcattaccggtgcttgtgcaggacaggaagtgggtcttgttatacagtacatggagaaatggaatatcaccctcaatattgggtctcgtaccgcc

SEQ ID NO: 1919 - DNA, 103 bp, Nicotiana tabacum
gtttcattttgtgacgcgtgcaaagaaagcggttcaaaatgcagatttttgtcaaaactttgactggcaagaccatcaccctcaatattgggtctcgtaccgc

SEQ ID NO: 1920 - DNA, 281 bp, Nicotiana tabacum
attttttgaaccgagactcagaaaatctctccttagaatctctgaaaccttccttcaggttagaaccaaaacaatattaaaacaaaaccaaagattctgatttaatatcaaaaatagattattttttcttaaaaaatgcttcttcgaagctcttcaagtcaattattgaagcattcatggtcaactccacactcatccccggagccagacttcatgcttcacgtaccaaaacagttctcaagatcaacatcatcaccctcaatattgggtctcgtaccgcc

SEQ ID NO: 1921 - DNA, 118 bp, Nicotiana tabacum
gttgtttcagcctatgctcatgttaggcatcacacttggtgtttctctaagtgttgtcttcccttattggctcatcactgtcctcatcatcaccctcaatattgggtctcgtaccgcc

SEQ ID NO: 1922 - DNA, 371 bp, Nicotiana tabacum
gagggtgattgaccgcctgaactggatgcgttatgtgcagggaccaatactgcgcgacgcgatgaaaattatcggcgaaatcgatctgcgcttaatgctggcgcaggcgctgcatatgggcgatgagtgccataaccgcaataacgccgggacgacactgctgattcaggcgctgacgccggggattattcaggcgggttattccgtcgagcaacagcgcgaagtgtttgagtttgtcgccagcagcgactacttctccggcccgacgtggatggcgatgtgtaaagcggcgatggatgcggcgcatggcatcgaatacagcaccgtggtcaccacccatggcgcgtaacggcgtcgagttccggcctggc

SEQ ID NO: 1923 - DNA, 132 bp, Nicotiana tabacum
agacccaatattgagggtgattggtgaaagcattctgcaacaagtctgtaagcctgtcctgagctttacttatttcacgtggtttgacgttatagtttttgttccagatcagctgccttgtagccatgaatc

SEQ ID NO: 1924 - DNA, 432 bp, Nicotiana tabacum
ttttatgaaaaacggggtaattatacagttccagtgctgaactattctgaaaactgagtaacatacaaataaaatctaagcaagcaaaaacggaaatatgtaactgagaaaaatgtctctcccgcctgccctctaacaagtacattcaactagtgctgctcaagtaatcgaatgcagttcaatatcaaaactatctaaaacaatcctctctaagcataataacgaaagatgggctggtttggagggtgacaatttgttgacttccatgaatgccgaatctgtccatcccatcacttcaatttcaagtcagcttccagaggaaatatctttccgcggtgattaaagatcatgaaatccagattggcaggcaaagcgaccaccctgttttcctcagattgaggatggattgaccttgaattttcccaggagcag

SEQ ID NO: 1925 - DNA, 437 bp, Nicotiana tabacum
ttttcaagaagatattcgatattcatatattaaaactggcataaaatgcaggtatagcacgaatgcatactggcttcgttcattctccatgtactaagataactagaggccaaactgacacaagacaaacatcctttgatacaatgaaaacataaaagcatatcacttaacaagcttgtccctcatttaacaccaataaaagctcaattctttctagagatgccaagcctgccacggaaatcatcctccattaggggaataccattgcgcagtttgatcgttggttcccagcctagtagttctttcgcctttgtgatgtctggctttctctggcgaggatcgtctggtgtattttccaccgtgataatttgcacttccggattgataagctccttcacagtctcagcaagttcaagcattgtgaattcacctggatt

SEQ ID NO: 1926 - DNA, 378 bp, Nicotiana tabacum
gccatatttaatctagttttgcggacttctttgcaagccacattttgcgaaggtaacttcttcttcttttgtgctttcttcttagttgtctatttttttcctttttttgaaggtcaaacaaaaaggagtgttcttgtttaacgagaagatccatacatgaagaagacaatcttgggtgtaaggggatgggtactcatccttacccgaatatcggagagattactcttatggcccaactatcagagagattaatctcaatgtggctcgactaccggagagattactctcaatgtggcccgactatcggagagattactctcaatgtggctcgactactggagagattactcttaaaatgacccgactatcgaatagata

SEQ ID NO: 1927 - DNA, 418 bp, Nicotiana tabacum
gcaaaaagaaatggctgatgaagttgtccttttggatacatatgtgagcatgtttggggtgagggctaggattgcactggctgaaaaagacatacagtatgaatacaaagagcaggatttgttgaacaaaacccctcttctcctacaaatgaacccaattcacaagaaaatcccagtcctgattcacaatggaaaaccaatatgtgaatccctaattattgttgagtatatagatgaagtttggaagaataaaacccctttcatgccttctgatccttacatgagagctcaagctaggttttgggctgattatattgacaaaaagatttatgagagtggaaagaaaatgtggacatcaaaagtggaggaccaagaagcagccaataaagaattcatagagtgcttgaagttattggaa

SEQ ID NO: 1928 - DNA, 443 bp, Nicotiana tabacum
ttttattgggagatttcttcttcaaaaaaaaaaagaaacgtttacggtacaataacactcaaaccaaacacaataaaaatagttttccaacaacaacaacaatattacgcctcagtcccaaacaacaagttgggaccagtttcctacggccccaattttattaacctgctgattcataggccacaacaactgttacgcctcggtcccaaacgagtcgggatcaattttactgtttgtgcaactcaagtgccttagaccaagcaggcctagccaaaatatcagcacaccaagccttaacatgaggtctagcatcaaacaaattcttaactttagtccccattaaataatgcacaacaggtgcatggtgtaaatctgctaatgtaaaactctcaccacccaaatattttgactctttaagtcttgattcatacacatcaagaatt

SEQ ID NO: 1929 - DNA, 386 bp, Nicotiana tabacum
cttatattgcttaactctctttcttattctctttaattttcaaatggctcctcttcaagttcttgcaatatttttcacatctttgattttcatgcaaatttatttgggaaatgctcaaacatttatccattctaaagcagcttattatccaaattcagaagaaaaaggaacagaaactggggcatgtggatttggtacttttggagcaacaatcaacggcggagatgtatccgctgcatctgatctttatcgagatggtctaggatgtggcgcatgctatcaggtgaggtgcacaaacagtaactgctgctctgataatggagttactatagttataactgaccatggagcaagtggtggcacagactttattctaagccagagag

SEQ ID NO: 1930 - DNA, 490 bp, Nicotiana tabacum
ttttaccattaaataaaattgtatatatatatttccataaaaaaaaattatgaataacaattactacatgtgatacaaaactgggaattcagaaagattaataaaacataagacatattcagtaatctagaaagtaatgtttataaagcttattcaagaattaacaacagtaaattaaacacaaatagacactctttttatcttctctggaagttgaatgccttaatacccaaagcaaatgtgaaggcgaaaacaactgcaaacgcaacgatcacagctgcaacaactccaagaaaatcatgcttaaatcctaagttacttctcagaaattgttccacagtttgattttgatcaataagtggatcttgaaggtctccgaattgagatgcaaccaaaccatacaaggtccatgcaatagggcaaccccagtagtaccatctccaccatattggaatacgaggtcgtggaacgatgaaacctgagaagagat

SEQ ID NO: 1931 - DNA, 488 bp, Nicotiana tabacum
attttgtcttggtctacaaattgaatatatgaaagatggaatttttgtccttcaatcaacatacactaaaaagattttaaagagtttctatgtggataaaacacatccattaagtaccccgatggttgtgagattactcgatataaataaagatccactctgacctcatgaaaataatgaagagctttttggtcctaaagtaccatatcttaatgcaattggtgcgctaatatatcttgctaacactacaaggcatgacataactttctcagttaatgtcttagcaagatagagctccgctcaaggagaaattggaatgaaatcaagcacatattgcgttatctaagggggattactggtgtgggcttattttatggcaatgattgcaatatcgatctttttggttatgtcgatgtaggttatttatctgacacacacaaggcttgatctcaaacatgttatgtgtttacatgtgtggcactgtcata

SEQ ID NO: 1932 - DNA, 369 bp, Nicotiana tabacum
ccgaaacaccactcaatctgacccaaaatgaaaaaagaaaaaggaaaaaagagggatgaaaaatagaaacaaggaagaatgaaaagaatagacaaaagctgaaaatttggtacgtggaaaatacaaggaacaatcacgtgtgttatgagctgaacggagactacccatcatgtgtaactccataactaccagaagtttgttcagtaagatggcgaaacaaattgtacaaaatggtggcaccgcggtagaaagggtcatcaaactaccataatagttgcaagaagaattgcaacagagctcatgagaatgctagcaacgacggaggattggccatttggaggagtgggagcaatagctgacccattgtca

SEQ ID NO: 1933 - DNA, 427 bp, Nicotiana tabacum
ttttagagaagtttatgtaatatttaaagacgtgttacagaaacctcataagatacgtaattctccctagaaaaaggagtgcaagttttccataaataccaaaacacttgacacaaaataacagtcagctttcctcccactatacaaatcaagcatcagctctttactccatccaccaaaaaatattgcaaaactacaacattgcaatctatattgagatagtatttgctatctcaatttgccaaaagattacaacatcaagaactgcagatgctttgattccacataattcagaaccctcttcctcttaagagatttctaaccaaaaacacctactcactataatacaaaacgtcatccttctattttgtgcctcgaatcatgctactctacatatgtctgtcgacacttactaacagctacaaaa

SEQ ID NO: 1934 - DNA, 412 bp, Nicotiana tabacum
ttttaggatgaaaagacagtcatcatatcataatatgacctaaaaaaacagaaagagctaattatgcataaaatttattagataataaggacagtaccaagtgttgtatatgtaatatgcagagaggaattgaaattagacataattagttctggtatgggcagtgttgagtggtggttttatcattattgccctgttgctcaatgttagactcagaaattggtggtcccttaagtagtccagcgaacagttgtgctggatcatagtatatctcaacatcctctgctcttagagattcatctaccttcattattccaacgccataaaactggaccatctcacgagtaggggcatgtccctttaaaaggtccttcaaagaaaccccaatgtctgaatttgaaagtcacaacag

SEQ ID NO: 1935 - DNA, 361 bp, Nicotiana tabacum
ttttgaaaatatagaggtaaatgaaatttttttttatggtggggggatgaagttctaatggcctatggactaaatattagtaatcactaagatatctacaatctcaattaaagtgacaacactaatcacataatcacttgtgtcctttgttccatcaaatgtgcatgaaattgctgagtaatctttctcgttcctgtgatgctgcaactgcaataaaatcaatcaaacctcttcctttgaacctgaagaagaatatctctctcccccttttactattgctgaatatcacaatccccctgttgcatatacattttttactggtgaaatttgtgatcgagcaacgaccttttacagccattct

SEQ ID NO: 1936 - DNA, 429 bp, Nicotiana tabacum
gtcgtccggacttgcgttaccctagagccgcccctgtcacagagtaatcgtcgtccggtagaagatgaggccgatattgatgaagggccacgaaaggccattgacgtttctgaaatacaacagagacggggatctgctcttctcttgcgctaaggaccatacccctaccgtttggttcgccgataacggcgagcgtctcggcacttaccgtggtcataacggcgctgtttggtgttgcgacgtttccagggattcggccaggctaataacaggaagcgcggatcagagtgcaaagctgtgggatgtccaaactggtacccaactgttcacattcaactttgattcccctgctaggtctgttgattttccggttggtgataagctcgcagtgatcaccactgatccttttatgggactgccatctgctat

SEQ ID NO: 1937 - DNA, 447 bp, Nicotiana tabacum
gtttcctatcaagacaaacttgcaacatagttttgaacataaaaatggattcttattcatatgcagctatttcttcttcttcttcttcctctaattctattccatatcaacaagaagtaaagaaaaacaaagcattaccttcataccattcctcacttcatggagttcgtaggctcccattaaaaccaatgacaaaacaaccaattgcaccgttgccaccaacacctccaaaaatctaccgagtggaacctgttaatttcaaggaagttgttcaaatgctcactgttgcacctgagtttcaatctgttttcaataattcgagctctgattccgactctagttctaataattccaattcaaggcgtttgaaggatgtggctcctcctccacttgatctctcaccagtttcattaccaagaaacagcattgctgcagaatggcgagagt

SEQ ID NO: 1938 - DNA, 394 bp, Nicotiana tabacum
ctaaaatctgtccaaatatctcatcttgtttatttagagtaataaattactaactacaaatggcaggaacaagtagttatcctcctcagatggctgtgccgccggcagcaaatcaggttgcaattataagcccacagttctgtgctccatatccagttgatttgaacatcgtgaggaaaatgatgactttgtctgaagggagtttcggagttaccgatgtcaacggcaacatcatttttaaggtcaaaggaaagctctttagccttagggatcgcagagttatggttgatgccgctggcaaccctctcgtcactttccaacaaaagatgttgactgcccataggagatggcaagtataccgaggagagagcaccgataccaaaaatttcctttt

SEQ ID NO: 1939 - DNA, 497 bp, Nicotiana tabacum
ttttcacgatgctcaactacacatttcattatggagacaggtaaatacatactcagttaagtttccaatcttttctaccgcgccaacttcctatctaagttacaaagtatattacttctgagagctcaattttaatatacatttgggcacaaaatcggccaaacttgcatcaccagactcggtcaacagcaagaaacatttaaatgaatagtatttacatgggacctcgtcaactcgttaagactgccaataagaaactggcacgaatccctccaccacatcagatagttcaaaagcaaattaccaggcatcgttcagggtaaagtgcaatccaatttacctactcagatgaccccgtgtgtaaggaaaggatgtctcagggcttcacgagcagttaacctttcagatggatcataacgaaggagtccttgcaagagattaataagatctccagcagaatgatccacatgctgcataattatattctgaaggcgagc

SEQ ID NO: 1940 - DNA, 501 bp, Nicotiana tabacum
ttttcaaaaccaacaggggttgatacttttgctgattacacaaaagcacagcttcaaaacataatgaaaaccatagatccaaaccagcaacagcaacaagctctaacatcttcagtcaacacttcatcttggatgaaggcttgtaaaaccaagcgatgttaacttgctgaccacacagaaccacagcttcaaaacataatgaaaaccacagattcaaaccagtaacagcaacaagcttagagtttcacaaattcctcaccaaagtggcatcccggagaaattacctcatgcagaaagcacatcaaacacaaggctatcaaatcttcaacagcagcagcagctccatttcttgatggacacggagaaaactaagcttcatattaactagaagcagcatatacatcaagcgcagcacgaaaaatttcaacttcagccgccagcaccaatgtgcctccagcttattggaagccacagccaccccccatcatttgatatgcatca

SEQ ID NO: 1941 - DNA, 304 bp, Nicotiana tabacum
ttttagagaagtttatgtaatatttaaagacgtgttacagaaacctcataagatacgtaattctccctagaaaaaggagtgcaagttttccataaataccaaaacacttgacacaaaataacagtcagctttcctcccactatacaaatcaagcatcagctctttactccatccaccaaaaaatattgcaaaactacaacattgcaatctatattgagatagtatttgctatctcaatttgccaaaagattacaacatcaagaactgcagatgctttgattccacataattcagaaccctcttc

SEQ ID NO: 1942 - DNA, 455 bp, Nicotiana tabacum
ttttaactcttaaaatccactgtctggaataaaattaaaagtatttcctcaacaactaatactacaacctgcttccgcctatcaagttgtacattcttagcaacaaagtttcactggctttaaaggctgttgaagtgaaaaacctcccacttcaaaaaccaatagcgtgcataatactgtaaccttggatactgcccgctgttgagccaattatgagttgcatattccagttacagtacataacagaagtctattcagacggagcaataaaaagtaataaataaaaaactgatggatgttattttatcgcttcccacgactccccgagccaccagacctcggacctggaaacttcgagaactgcaatcgcaagtaggccgaatcggggtcatgttcatccattttgtaaccttgcaatgcactcaaagcagtagctgcacaagctggatctacga

SEQ ID NO: 1943 - DNA, 328 bp, Nicotiana tabacum
ctcacctggtgatacacctgatcaccctgctgttggtggttctgctgatggttatgcttctgaagactttgttgctggttcttcctctagccgtgaaaggaaaaaaggggttccctggactgaggaggagcataggatgtttctacttggtttgcaaaaactcggtaaaggtgattggcgtggaattgctcgtaactatgtaatttctagaacgccaacgcaggtagcaagccacgcccagaaatatttcattaggcaaagtaatatgtcaaggagaaaaagacgctctagcctgtttgatattgttgctgatgagtcgggggacact

SEQ ID NO: 1944 - DNA, 323 bp, Nicotiana tabacum
ttttcgacccaaattcaattgcaataacggagaagtgggtttaaagtagcacatatatatacaggcattcagaagtggagtttcttctctgtaacttttttactgggtggttcctgggaagagtatttcaccttaaacaaacactgcaacaaataccaaatcacagaaaggaccgacgaacagcacacaaaagtaatctctcattcccctggtacaattcacctacatgcatgtgatggcaactgctacctaaacagacgcatttgcagcaagagcagcaaggactttccacttctgcgacttggaaaggttccgccacattt

SEQ ID NO: 1945 - DNA, 437 bp, Nicotiana tabacum
gaggaggaacgtatagctgcaagcctgcaactccctgcgaatttggatatatacacagagagagaaggggaatggagaatcttcgccaaaggcgagcaaaaaatccctgttctcttcttctttcttttgtattgatcactgccctctcttcatccatatccgcaacttcacctcttcctcgctcagatcagggtacagagcagcatgcgtcaagtcctgaacacgacaagccacatgttcatgaagttcattgctcccgagaaagaagccggactgcttggaaagttattgaggagtacttgatgccctttgtggaaagagagaagtatgagcttcctaggcagtgtagacttcatccaagtaatgatattttcagagatcaagaggaacataaaatccatcttgacgtgaatgagtggaaatgtggatactgcaga

SEQ ID NO: 1946 - DNA, 328 bp, Nicotiana tabacum
ggaatgccagcaagcaggtctgcacaaagaatactggtgacttggaagttcagatggtaaatcaagcagaaccagagttgcatgaaaatgctgctgttagtactcaaggtacagaatccggagctgcacctattggaggagatatgactgagcggagtgccgttactggagttgggcagcttacttctggagtagatagttcagccagttgcttggagcagcaaataacatgtgttacagaagcagaccaaggccggggtacaaacacaggggcagaaatttctttatgtatttgattttgcattgttccctgttgatggacttcccc

SEQ ID NO: 1947 - DNA, 413 bp, Nicotiana tabacum
ggaacaatgcaaggactatccgtatgactacgactattgataaaaatcaatggtgtggacaattcaagcgatgcaatgaatgcaagctgcaatcggaatgcatggttaagcctgaagaaatgtttcctgtaatggaagatgggaaatatgtcgataaatgggcaatacgaacgacggcaatgattgccacgagaacttggtaaacagaacaacaaagctgcctgatagtggcctttatttttggcataaataaccagaataaaccactgcactgtgtattcattccaacgagtgaatacacggagcaatgtcgctcgtaactaaacaggagccgacttgttctgattattggaaatcttctttgccctccagtgtgagggcgatttttatctgtgaggatatgaacagatgtc

SEQ ID NO: 1948 - DNA, 359 bp, Nicotiana tabacum
tggctaataagattgttgctgcagtgaagcagctggaaggaattgagtaaggcgagaagcaattcagaatggaggttgcaactataagtagcacacaccatttgaatttggtgagattaattgggttttgttctgaaggacgccacaggctactggtgtacgagttcatgaaaaatggttctcttgataagttcctctttgcggaagatcattcgtcaggaaagcttttgaactgggagcatcgatataatattgctttggggacagcaagaggtatcacataccttcacgaggaatgtcgagattgcattgttccctgttgatggacttccccaatcactagtgaattcgcggccgcc

SEQ ID NO: 1949 - DNA, 453 bp, Nicotiana tabacum
acaatgcaagagcaaagacgaaaacatgccacacatgaggaataccgattctctcattaacatattcaggccagttatctgggcttaaaagcagaagtccaacccagataacgatcatatacatggttctctccagaggttcattactgaacactcgtccgagaataacgagtggatccatttctatactcatcaaactgtaggggttgtaatagtttatccgatttctcgctgtaggggtacacgagaaccaccgagcctgatgtggttaaaagacaggcacaatctttactaccgcaatccactatttaaggtgatatatggaagaagaatttgaagagttcgaagagcatcctcaggatgtgatggaacaataccaggactatccgtatgactacgactattgataaaaatcaatggtgtggacaattcaagcgatgcaatggatgcaag

SEQ ID NO: 1950 - DNA, 357 bp, Nicotiana tabacum
gagatttcgtacagagagaaaagaacatgaatggagtcgctccgccgaggagttcgggttccgacggtggcgccgtcgaaagtacgacggttctccgggcttatcagacctggaaaggcagcaacaaattttgtcttcaaggaaggtttatatttgggcctgacgtgaggtcactctttatgactatcttccttatagttgccccagttgctgtgttttgcgtctttgttgcaaggaaaattgtggatgactttgctggtcattgggggtggtctatcatggtcgtggcggtcatttttacactatatgtcttagtccttcttctactaacatctggaagagatccctggtataatt

SEQ ID NO: 1951 - DNA, 452 bp, Nicotiana tabacum
aaattattagaaggagaagaagaagcacttttcataaaaggttcaagtgcttccattagttcaccaccagaagtaataggttctgatgttgagtgaacatctacaggtgtactattccaaaaatccattgctgctgccattacctaaaatacctgttcacaaaaaaagttaaaaaaagtaacctgtttcttgtcaaataaaagaaaacaggtgagtgattttgattacaaatatataaacagaaaaatggatatcaaagaggtcttcaaataacaacctcttttttctcctgtgattaaaaggaaaaaaaattcaacctttgagggacaactaataagccctctaagctgattttgaaagaaagaaaaaaaggtctgaaactatactgagttaattattactagatctcgattctgaaaacacctggcttataagaaaatatttcgtctaat

SEQ ID NO: 1952 - DNA, 462 bp, Nicotiana tabacum
agaaatttgcaagaaattatgatacagattcacattcaaagccagtatataactagagattaaacatggaaagcacagggccgggcatattacaaatatgaaaaaccatgaactagttaattacttccattctttcatttcacttcttcgacttcatccaatgcgtagttgttggtagatacattagcatagttcactttgttgaaccttactacgactgggtagcgtgtgtttggatcctgatcaacagctacaactgaaccaacacccttgtaccagtaagactccttccttaaaactctcactttggttcctctcttgggtccaatcggaggtggcttggcagctttggcaggaggagcttcaccttcagcggtggcggtagcagctggcggcgcagcctcttccgcggccctaacaacgagcctcgggaagttggtggtggtgttgttcttggaggag

SEQ ID NO: 1953 - DNA, 314 bp, Nicotiana tabacum
ttttgacggctgaagagcactttaggaaggctactaacagttgacacaacaaaagattacaaaccatttactcggtgatcaaaatgacaagtaccggatgctcctatccagatcaaaatgtcaactaacagaaacacaaactagtttattcaactatagtttccatagcaaaataagtagacaccttttgtagccaagcacctcggatccaactgacactaagacacagaaagcttataaaatggataatggataggccaaacaacttctattggatataagttaacagtactgataatattgtccatgaaatg

SEQ ID NO: 1954 - DNA, 310 bp, Nicotiana tabacum
cgggatccaacgctgatgaaactcgtggggcatgcaagaggtgtgggcgggtaggccacctcacattccagtgtaggaattttgtgagtgttaaggatgataacaaggataaggatccggaggcgattgaggctgccgtgttgtctggattggagaagatcaaggggtctaagatgaagggaaaagcagaaaatgaggagagcagtgaagaagaagaggagagtgagagttctgattcggattatgattctgaaatggagagggcaattgctgagaagtatgggaagaaggtgagtaggaagttgaagtc

SEQ ID NO: 1955 - DNA, 216 bp, Nicotiana tabacum
cgaagtgtgacaatctctccacggacagcatactcacagttcaaaaccttggggttaagggtgtctagagtgacaggtgtggatgaataatcggaagccattgaatcaggagaaggagaagaaggctgaagagtggacaagaaacgaaacgcagcaggtaatggggaagtaagaggaggagaagaagaacaaatagaagtagtagttctagttctg

SEQ ID NO: 1956 - DNA, 236 bp, Nicotiana tabacum
aagtgtgatggagcggatacaggtgtaacaacagcagttggaggtgatgctactggtgcaactggtgatgcctttggtgtagctgccggagaagctcccggagcctgagcaaaagcagatccggcgaccaaagcgaaaatgaaagcgaacatcatccttgagtaagccatttctttctctctctagaagcttttcgaaagctctgatttgaagtgttgagcagtttttagagagcg

SEQ ID NO: 1957 - DNA, 365 bp, Nicotiana tabacum
aagacccaaattctcgcagtgaaaaccaaaagaatgggtagcagccaagcagcagtatcattcctcacgaacgttgcacgcgccgccttcggtctaggcatcagcgccacggttctcaactcctccctctacaccatcgacggtggtcaacgcgccgtcctcttcgacagattccgtggagtcatcgacgataccgtcggcgaaggaactcatttcctcgtcccatggcttcaaaaacctttcatcttcgatatccgtactaggccccacacattttcctccgtttcagggacaaaggatctccagatggtccacctcacacttcgcctcctttgccgcgaatcactagtgaattcgcggccgcc

SEQ ID NO: 1958 - DNA, 545 bp, Nicotiana tabacum
tgtgaaccggttataaatctgctctttcgcggtatccgtaccgatttcggtaaggtaaaccccgtttttgtttcgcttacgtggcatgctggccaccggcttgccgtagacggatgcccctttaacggggatcacccggaacagcccatgttttttcgagcgttcatacacaatggtcgggtcaatcccgccagtatcccagcagatacgggatatcgacatttctgcaccattccggcgggtataggttttattgatggcctcatccacacgcagcagcgtctgttcatcgtcgtggcggcccataataatctgccggtcaatcagccagctttcctcacccggcccccatccccatacgcgcatttcgtagcggtccagctgggagtcgataccggcggtcaggtaagccacacggtcaggaacgggcgctgaataatgctctttccgctctgccatcacttcagcatccggaccgttcgccaattttcgcctcccacgtttcacccgagcgtggtgtttacgaaggttttacgtttttcccg

SEQ ID NO: 1959 - DNA, 425 bp, Nicotiana tabacum
cgtaggaaagaaattgctgcctttttcggtcaaacttctcacgaaactactggtggatccctgagtgcagaaccatttacaggagggtattgctttgttaggcaaaatgaccagagtgacagatattatggtagaggacccatccaattgacaaaccgaaataactatgagaaagctggaactgcaattggacaagagctagttaacaaccctgatttagtggccacagatgctactatatcattcaaaacagctatatggttttggatgacaccacaggacaacaagccatcttcccacgacgttatcatcggtcgttggactccgtctgccgcggatcaggcggcgaatcgagtaccaggttacggtgtaattaccaacatcattaacggtggaattgaatgtggcataggacggaatgacga

SEQ ID NO: 1960 - DNA, 363 bp, Nicotiana tabacum
cggggaaaatattgtacacacaatgaagggaacatctggggataaatttgagttcaaggcccctcggagtgggatgtacaagttctgttttaagaatccttattcaacaccagaaactgtctctttctacatacatattggacacatccccaatgagcatgaccttgctaaagatgaacatttggaccccattaatgtcaaaattgctgaactaagagaggcattggagtcagttacttcagagcagaagtacctaagagcacgtgaagctcgtcatcgtcatactaatgagagcacaaggaagcgtgttatattttacacaattggagaatatctgctgcttatattggctagtgggcttca

SEQ ID NO: 1961 - DNA, 288 bp, Nicotiana tabacum
tgctagatatgacaggaaacccttcccaaccatacacttgggccttcaagaaagagatcactcaactaggaacataatcagtcacaccacgccactcgatccgcggcacacccgacatgactgtcttagcatgatagtctagaatagcatgacacagagatagtcaatccatgccccaaaatgacatcaaaatccacccatgctcaatagcaatagatccactttgggtctccagacccccaattagtcaccacacatgaccggtccacacggtctacaaataatagt

SEQ ID NO: 1962 - DNA, 619 bp, Nicotiana tabacum
gtgtccggcgacgagcctatacgtgagaagatctttcatttcagcagagaagctattttgaagctgaaattcagagccaacaacaaaatgacagttaacggtcaaaacggaagaactaacggaaagataaggcccgttaagaacgagccggctttgaaaaacggctaggcttcagaaatttcatcattccagtcgttgtgtgctcagttgtggagatccgtgacgcgggccaggaaattggaggggagcaaaacgacgacgtttaggatggcggtgaattgtcgccatcggatggagaaaaggatggagccgctctattttggaaacgcgattcagagcatcccaacggttgcttccgttaatgagctgttaagtaacgagttgaattggagcgcgaatctgctacatcagaatgtagtggccgcatgatgatgctaccgtgcgccggggtgtgaaggattgggaaagtaatcctaggttatttcctttaggaaattttgatggagctatgatcactatgggaagttcacctaggtttccaatgtcgataatgatttcgggtggggcccgcccgtggctgtccgaaagtggcatggctcataaattttgacggtaagat

SEQ ID NO: 1963 - DNA, 399 bp, Nicotiana tabacum
catgggccatttacaccagacgcgatggatccatacacagacaaaatgaatatctggcagaaaatcgacaactggttatcagttttgtacattaagccctcgctctggaagatacacgagaaggcggcgagagaccatttcagggaaacatacggccccaaatatgaagcccttgttgatggatgctggacaaatatcagcctttcaatgatttcatcaaactttttgtactactatccgcgtcttcacggcccaaatgtcattgaattgggacctctgcatttgaagacaccagcaaaacctcccaaagaatctgcaagattggttggacggggcagaaaaaggagtaatctacttcagtcttggtagcaacatgaaaagtaaagccttaccagaaaa

SEQ ID NO: 1964 - DNA, 200 bp, Nicotiana tabacum
gtcaaccgaggatcaggtgaggagccttgacgaggaataaagctcatgagttggaggggaggttggtggctatgggagcctggaggagtagcggggatgctagcgagatgtggacagctacatcagactgtataagaaaggcggcgagagaggtactaggggtctcgaagggttactatgccgggcacccccgccgccca

SEQ ID NO: 1965 - DNA, 403 bp, Nicotiana tabacum
acgagcctatacgtgagaagatctttcattttagcagagaagctattttgaagctgaaattcagagccaacaacaaaatggcagttaacggtcaaaacggaaaaactaacgggaagataacacccgttaacaacgagctggctttgcaaaacggtgcggctgtgaagggtacggcttcggagatttcatcattccaatcgttgagtgctcagttgtggagatccgtgacgcgggccaggaagttggacgggagcaaaacgacgacgtttaggatggcggtgaactgtcgccatcggctcgagcaaaagatggagccgctgtattttggaaacgcgattcagagtatcccaacggttgcttccgttaatgagctgttaactaacgacttgaattggagcgcgaa

SEQ ID NO: 1966 - DNA, 368 bp, Nicotiana tabacum
ggtcaagagtcagtcgtggttgaggggaggtgccgaggtggggtcactccatatgacaggtaaataagacggcgtgaagagtcaagaggtaacagcagtggcatcttgggaattttatacacggttcccctgcattgcttgtgttgttttggtgaaagtatggaagttattatcagtgaattagcttctcagagtgcggagtcccttttccagttagcacatgagatgtatctgcagtctgtctgaaaagagtctgtctatagtatttcgagttgcagggtgaatgtctatactttacgagtcattttctataaatattgcaaaagtacatgtttgagcaattttgattattctttgtgcccttaaaa

SEQ ID NO: 1967 - DNA, 509 bp, Nicotiana tabacum
  modified_base (11)..(11): a, c, g or t
cggcgcatggntcatttacaccagacgcgatggatccatacacagacaaattgaatatctggcagaaaatcgacaactggttatcagttttgtacattaagccctcgctctggaagatacacgagaaggcggcgagagaccatttcagggaaacatacggccccaaatatgaagcccttgttgatggatgctggacaaatatcagcctttcaatgatttcatcaaactttttgtactactatccgcgtcttcacggcccaaatgtcattgaattgggacctctgcatttgaagacaccagcaaaactcccaaagaatctgcaagattggttggacggggcagaaaaaggagtaatctacttcagtcttggtagcaacatgaaaagtaaagccttaccagaaaatgtgcgggaaaactttctgagatttttcagagagctgcccggctggttacagggtactgtggaagtgggagctcgatggcaaaatacccggacacccccgccgcca

SEQ ID NO: 1968 - DNA, 161 bp, Nicotiana tabacum
cggcaagccgttacactacaaaggatcatcatttcaccgtgtgatccctggatttatgtgtcaagtaggtgatttcactgccggaaacggtaccggtggtgaatcgatctacggcgccaaattcgccgacgagaatttcgttaaaaagcatactggacctg

SEQ ID NO: 1969 - DNA, 501 bp, Nicotiana tabacum
ctagagggcaaaaggggggatcaccaagaatctggtggcaaaaagtcccctcctagtttatggtttacatactctgattcacaaagacatgtatagcgctagcacttataacttgtctaaaattctaccacctattaatttcatccgataaacggtcatttacaacaaatagtatataaagccagatacctgctttatatgattttgcatgtattgatgtatggcgactttcaactccaataagttagagtaactaccaacgcagccggtgaactttctacacgttccccaattttgcactcccccaggaaaacctaatcagccgagtaagttcacaaaacaccagagtccaaagctttgattgttttgcgtcgccacatagcagttcctggatcaaacctcagctcccatgttggccagtaatgtaaatcctgcttcaatgtaagtctcgaggcttcccattcaggtggactgttcgtacccggacaccccctcctccaa

SEQ ID NO: 1970 - DNA, 559 bp, Nicotiana tabacum
cggggcccacaccatcggaatcagccactgcacttccttcactgaccgtctcttccctaaccaagacccaaccatggacaaaacattcgctaacaaccttaaaaccagttgtccaaccgcgaactccaacaacacagtcgacatggatatccgaacccctaatttatttgacaacaaatactacgttgatctcatgaataggcaagggcttttcacttctgatcaggatttgttcactgatagaaggactaggggaattgtcgagagctttgctaagaaccagtcactgttttttgacaagtttgtgattggtatgatcaagatgggacaattaacgtgttgactggtggagatggtgagattaggacaaagtgtgataggaggaacaaggataagaaggttgatattgctaccgtcgttgaagatgtggaggaaactttctctgctttgttttaagtttaataatcctttgttttcatgtctgggagaaaaaacttttttatgcttttttttttgtaataataacgaagtatcttatatgcttagttaatattcaaaa

SEQ ID NO: 1971 - DNA, 291 bp, Nicotiana tabacum
cggccgaggatcttcgtaagttgttgttttgttgatatgattaatgtaatagggtcttccatctgcgtcaatagcctgtttccaaccataaggcaatccaccattgacgtcatggacccaagcttcggccggtggtacccaagaggacgtctgagttacatgattgcaatagtagagtcgattgtcgtgtgtcacgtgaacgctccagccgggattgagtttattttggatctgttgcaggttttccttccgtttctcaaccgccgctgccccggacaccccctccgccca

SEQ ID NO: 1972 - DNA, 399 bp, Nicotiana tabacum
  modified_base (236)..(236): a, c, g or t
ttctcgatggtcgtattaaataaaataaaaaatagtcaaaattttaacaaccccaaaagacttttttttcgtttctgccccaatcttccccaaatttacatacaaaaccctacccaccgtatctctattctctgctctttagtcttctccaaatgtcaattccaccctttccactacctcgaaattacaaaagagcccctaaatccctaagctgtttatccttttctctgttccgntgaatcgaacaccatcattctctcgccggaacttccagctccggcgccggcgatcgtcccttcaattacatgacgatgctctccttcgtaagttacaataaccatttttggatcatcggttgccctctccacatgctttcttgccggacaccccctcctccca

SEQ ID NO: 1973 - DNA, 347 bp, Nicotiana tabacum
  modified_base (109)..(109): a, c, g or t
  modified_base (198)..(198): a, c, g or t
cggggcgtaagtcccgactgccgaggtgtaagtctcacggaactaagccccacacataagtcccggggcgttttacgagtgctccgctccagggcgagccccgggcgangtcccaattctgccttttaaaacagagctaattactatagtacaaagtaattttattctgtgcagtggagcatgaagtactcgaaagangaaagaggaagactacgatgcattatatcagcaacagcaactgccacagtcacagcagcaacagcaatcatcttccagccatcggcgcagcactagtagggatcttgatcaacaatttgcaaacatctccttgaaacataaagacggta

SEQ ID NO: 1974 - DNA, 491 bp, Nicotiana tabacum
cggggaaaatattgtacacacaatgaagggaacatctggggataaatttgagttcaaggcccctcggagtgggatgtacaagttctgttttaagaatccttattcaacaccagaaactgtctctttctacatacatattggacacatccccaatgagcatgaccttgctaaagatgaacatttggaccccattaatgtcaaaattgctgaactaagagaggcattggagtcagttacttcagagcagaagtacctaagagcacgtgatgctcgtcatcgtcatactaatgagagcacaaggaagcgtgttatattttacacaattggagaatatctgctgcttatattggctagtgggcttcaggttgtgtatatccgacaactgtttagcaagtcagttggctataaccgggtttgacaaatttaggttgtagcatagtgttttttcacctctgttctacaggaacttgagttgttttggtcagttgagg

SEQ ID NO: 1975 - DNA, 215 bp, Nicotiana tabacum
  modified_base (9)..(9): a, c, g or t
cgggtacgnaacagtccacctgaatgggaagcctcgagtacttacattgaagcaggatttacattactggccaacatgggagctgaggtttgatccaggaactgctatgtggcgacgcaaaacaatcaaagctttggactctggtgttttgtgaacttacttggctgattaggttttcctgtggggagtgcaaaattggggaacgtgtagaaaga

SEQ ID NO: 1976 - DNA, 354 bp, Nicotiana tabacum
cggcttgctaatatcggagtatcaagtaagaaaacgcttgtcccacagcagtggtgcaatcccgcagtgatctcgacaaaggtatagcagtctacttcaaacctaaagagcccaaacatcagcagattgtggagtcttcttcgttaaacatcaatttctattttgatagtaataagtgtgctaacctaacagtgtggaaggtagacaactaccctatacctcgaaagtacagcacaataagcacaggtgcaaagttgggaaatcccctggatgtgaatagctggtttcaaattaagcctcttggtggctcgacgtataagctagtgttctgtccctacggagaggagtttacta

SEQ ID NO: 1977 - DNA, 315 bp, Nicotiana tabacum
  modified_base (81)..(81): a, c, g or t
cgggtacgaacagtccacctgaatgggaagcctcgagtacttacattgaagcaggatttacattactggccaacatgggangctgaggtttgatccaggaactgctatgtggcgacgcaaaacaatcaaagctttggactctggtgttttgtgaacttacttggctgattaggttttcctgtggggagtgcaaaattggggaacgtgtagaaagttcaccggctgcgttggtagttactctaacttattggagttgaaagtcgccatacatcaatatatgcaaaatcatataaagcaggtatctggctttatata

SEQ ID NO: 1978 - DNA, 295 bp, Nicotiana tabacum
taataattcgtatatttaaccaaaaggtggagaaatcacaagcaccactctttgatgcaagtaaaagccccaccttttttcttcaattaataaaggggacacaacaaacgtggagtaggcacagccacgatgtcgattagctcttggagcagtgagtccaaaaatatcatccattttaagctcacttggtttcataccatctggcaattcccaagtaaaacaatgaagaagatgggccacagccatttccaatgcataaagcccaagttgcatacccgggcacccccgccgccca

SEQ ID NO: 1979 - DNA, 267 bp, Nicotiana tabacum; identical to SEQ ID NO: 877

SEQ ID NO: 1980 - DNA, 178 bp, Nicotiana tabacum
cggcttgctaatatcggagatcaagaagaaaacgcttgtcccacagcagtggtgcaatcccgcagtgatctcgacaaaggtatagcagtctacttcaaacctaaagagcccaaacatcagcagattgtggagtcttcttcgttaaacatcaatttctattttgatagtaataagtgta

SEQ ID NO: 1981 - DNA, 551 bp, Nicotiana tabacum
cggcttgctaatatcggagatcaagaagaaaacgcttgtcccacagcagtggtgcaatcccgcagtgatctcgacaaaggtatagcagtctacttcaaacctaaagagcccaaacatcagcagattgtggagtcttcttcgttaaacatcaatttctattttgatagtaataagtgtgctaacctaacagtgtggaaggtagacaactaccctatacctcgaaagtacagcacaataagcacaggtgcaaagttgggaaatcccctggatgtgaatagctggtttcaaattaagcctcttggtggctcgacgtataagctagtgttctgtccctacggagaggagtttacttgccaaaatgtaggcatcactgaggaaaatggatataggcgtttggttctcacagagaatgcaaaggcctttgtgttcataaagcatggcggattaggaaaggccgaagcatgattatgcatctgctttctaataaaactaagttgtgtaaaacatgtattaatgcaggccctgcattcggtgtttcactggatgtaaga

SEQ ID NO: 1982 - DNA, 575 bp, Nicotiana tabacum
cgggtacgtaacagtccacctgaatgggaagcctcgagtacttacattgaagcaggatttacattactggccaacatgggagctgaggtttgatccaggaactgctatgtggcgacgcaaaacaatcaaagctttggactctggtgttttgtgaacttactcggctgattaggttttcctgggggagtgcaaaattggggaacgtgtagaaagttcaccggctgcgttggtagttactctaacttattggagttgaaagtcgccatacatcaatatatgcaaaatcatataaagcaggtatctggctttatatactatttgttgtaaatgaccgtttatcggatgaaattaataggtggtagaattttagacaagttataagtgctagcgctataaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccgga

SEQ ID NO: 1983 - DNA, 254 bp, Nicotiana tabacum
cgggtacgaacagtccacctgaatgggaagcctcgagtacttacattgaagcaggatttacattactggccaacatgggagctgaggtttgatccaggaactgctatgtggcgacgcaaaacaatcaaagctttggactctggtgttttgtgaacttactcggctgattaggttttcctgggggagtgcaaaattggggaacgtgtagaaagttcaccggctgcgttggtagttactctaacttattggagtta

SEQ ID NO: 1984 - DNA, 368 bp, Nicotiana tabacum
  modified_base (294)..(294): a, c, g or t
cggggtacttaacagtgtaagtagcagtagacagtgaaggagattgtgacttcctggttagtaacaattccagcgggtgctacctttgctgttggctacacatggatattcactaagctcttatcatatatactctgagtgtaaattaacggataacgccaccactcaaacttcttggattaattataaaatcacacagataaccttttttgtcgtgatttgagaaatgcaatttttgaaccttgtggaggatccatgataaagagtagtagtccattcagtttagaagacganacaagctttgttttctgcctagcactttgcctccctatataagctgctaacttttgtgttggatttaagcaaaa

SEQ ID NO: 1985 - DNA, 232 bp, Nicotiana tabacum
gttttacatatccactggcacacgtccatacaagtgtgcaggcaatcttggagtaggaatagcttgtattggatttttcatgtaagttactgttccagggctctcctccaagtcaatattctccgggttaacccccgggggcggagcccacgtaaaatgatgcaacaaatgacccaacatagatgtgaccaagttgatagcaagttgtgcacccggacacccccgcctccca

SEQ ID NO: 1986 - DNA, 189 bp, Nicotiana tabacum
cggggaaaatattgtacacacaatgaagggaacatctggggataaatttgagttcaaggcccctcggagtgggatgtacaagttctgttttaagaatccttattcaacaccagaaactgtctctttctacatacatattggacacatccccaatgagcatgaccttgctaaagatgaacatttggacca

SEQ ID NO: 1987 - DNA, 644 bp, Nicotiana tabacum
gttacattacaagtaaacagaaatgtcagtagtcctagccgccttgaacagccttggccaagccaaaagcagcagcagatgcaactgctccaatgagtgcagtttgaaaagcgctcctaaacggcttgtttccagtaaagtgacctttggcgtatccaaagattagtaaggccagcaaagttaccaacacagaagcgacaacagcctttcttgcgattggaatgaacatgtatgggatcagagggactagtcctcccaagatgtaagcaacggcaatggtaaacgcactctgcagcgctcttcttggatctggcttctctaaaccaagttcaaacttcatcataaagtcaagccatgccggtgggttcttcctcaaagcattcacaactggtccatattcatggggctgaatcccatattgtaacaaaatttctgcaatctccgctgcttctgtatctggtacagaaatgatctcttcttcctccctcttaagctctctcatatagtgatcagcctcactcttggcagccaagtaacctccaagtcccatggagatggcaccagcagcaacctcagcaataccagcagtaagaataatagaggaagacgcatttgcccctgatagccccgccgccaatgcaaac

SEQ ID NO: 1988 - DNA, 252 bp, Nicotiana tabacum
cggcccttccctggtaccctgcgcatagcaggagcttagtgcaccgggttgccctttatggagggttcatgcatatgatgttacattaagtgcaatttatgagctagtattattaaggcatatgttaacagaagttcttgaatattgtgagttgtgccatgtaatgaagagatcaatgtgtctactaacaaaataatttaaaagcgagtacgataatattggtaagataaaagaggtatatgttctcttgta

SEQ ID NO: 1989 - DNA, 128 bp, Nicotiana tabacum
cggggacttaacagtgtaagtagcagtagacagtgaaagagattgtgacttcctggttagtaacaattccagctggtgctacctttgcagttatctacacatggatattcactaagctcttatcataa

SEQ ID NO: 1990 - DNA, 422 bp, Nicotiana tabacum
cgggacataatcatcggagtctccgatggactaacggtgccgtttgcattggcggcggggctatcaggggcaaatgcgtcttcctctattattcttactgctggtattgctgaggttgctgctggtgccatctccatgggacttggaggttacttggctgccaagagtgaggctgatcactatataagatgagcttaagagggaggaagaagagatcatttctgtaccagatacagaagcagcggagattgcagaaattttgtcacaatatgggattcagccccatgaatatggaccagttgtgaatgctttgaggaagaacccaccggcatggcttgactttatgatgaagtgtgaacttggtttagatgaagccagatccaagatagatgcggctgcagagtgcgtttaccattgccgtt

SEQ ID NO: 1991 - DNA, 429 bp, Nicotiana tabacum
cggggcccacaccatcggaatcagccactgcacttccttcaccgaccgtctcttccctaaccaagacccaaccatggacaaaacatccgccaacaaccttaaacgcagctgccccacagctgattctaacaacactgtcaacatggacattcgaagccctaatgttttcgacaacaagtactacgttgatctcatgaataggcaagggctttttacatctgatcaagatttgttcactgatagaaggactaggggaattgtggagagctttgctaagaaccagtcgctgttttttgacaagtttgtgattggtatgatcaagatgggacaattgaacgtgttgactggtggatgatggtgagattaggacaaagtgtgataggatggatacaagatataagatagcttgatcattgctactgttgttga

SEQ ID NO: 1992 - DNA, 568 bp, Nicotiana tabacum
cggggcccacaccatcggaatcagccactgcacttccttcaccgaccgtctcttccctaaccaagacccaaccatggacaaaacattcgccaacaaccttaaacgcagctgccccacagctgcattctaacaacactgtcaacatggacattcgaagccctaatgttttcgacaacaagtactacgttgatctcatgaataggcaagggctttttacatctgatcaagatttgttcactgatagaaggactaggggaattgtggagagctttgctaagaaccagttgctgttttttgacaagtttgtgattggtatgatcaagatgggacaattgaacgtgttgactggtggagatggtgagattaggacaaagtgtgataggaggaacaagaataagatagcttgacattgctactgttgttgaagagttggaggataactttctctgctttgttttaagtagtcttttgtttttgtttcaaaaatgctttttattgcttttttgtgataatgacgagtgtcttagctagcataaatgcataataataaacctttgttttgtgatga

SEQ ID NO: 1993 - DNA, 286 bp, Nicotiana tabacum
cgggacagtcgggagcaatgtgtggctgaggtcaagctgagcgggagtgtagacaccggcaatcgggttgatgaacgcgaggtagcggcaggtttaccgacagcagaaggagtggtacaaggtctgagcaatgacgggaccttgcgaggcgtgaccagcagcactcgcgcgcgaacgccgacgccaagggtggtgcagagttggcgagtcggtcagggacaaagtcgaaacacgtctgataagaagtagaaattgtaggctgcaaaacgtttgtttccattcaaaa

SEQ ID NO: 1994 - DNA, 184 bp, Nicotiana tabacum
cgggtgtggaccgctgacattatacccgaggagctcatgccatttactgaggaatgaagctatactcgtaagtggtgcatctcgtgctttatcagttctgtcaatggcgaaagccggtttcgtaattgtgccttcttctcttcctctacagcggtttcatggtgccgggcaccccctccgccca

SEQ ID NO: 1995 - DNA, 521 bp, Nicotiana tabacum
caaaaaagcaataaaaagcatttttgaaacaaaaacaaaagactaacttaaaacaaagcagagaaagtttcctccaactcttcaacaacagtagcaatgtcaagcttcttattcttgttcctcctatcacactttgtcctaatctcaccatctccaccagtcaacacgttcaattgtcccatcttgatcataccaatcacaaacttgtcaaaaaacagcgactggttcttagcaaagctctccacaattcccctagtccttctatcagtgaacaaatcttgatcagatgtaaaaagcccttgcctattcatgagatcaacgtagtacttgttgtcgaaaacattagggcttcgaatgtccatgttgacagtgttgttagaatcagctgtggggcagctgcgtttaaggttgttggcgaatgttttgtccatggttgggtcttggttagggaagagacggtcggtgaaggaagtgcagtggctgattccgatggtgtgggccccggacacccccgccgccca

SEQ ID NO: 1996 - DNA, 168 bp, Nicotiana tabacum
cagcaagcacagagacacagaatggcgggtttcaatatcattttgcaatccatcatgataaacctgccttgcagcaaaaagatctacggccaacaagtgaatccatgcagaagctaatgtcatctcgttggagaacatcttagttatgccgggcacccccgccgccca

SEQ ID NO: 1997 - DNA, 166 bp, Nicotiana tabacum
cgggtatgcaacttgggctttatgcattggaaatggctgtggcccatcttcttcattgttttacttgggaattgccagatggtatgaaaccaagtgagcttaaaatggatgatatttttggactcactgctccaagagctaatcgactcgtggctgtgcctactca

SEQ ID NO: 1998 - DNA, 283 bp, Nicotiana tabacum
gtaattcacagtttccatatttaggttgttgatgaacaatgtacgcggccccaccgaaataacacgaacccatcgcacgccctttcttctgataataactattgaaagcatatgatgcatgagcttccagcgtgttaggattgtaacacgtggaccctggctgaatcgaacggcaatcagctccgccctcaccacaagcgaaatctagagctgcttgtagattatccttccccgcttcaccactcgccacgcaccacgtttgcccggacacccccgccgccca

SEQ ID NO: 1999 - DNA, 500 bp, Nicotiana tabacum
cggcagccaaagtcttttatgcagggtcctcagccctttcatcaactgcaaatgctatcacctcaacaccagcagcaacttatcccagcacagcagaacttgacctcaccatctgctagtgacgtcgaaagcagaaggctacgaatgctccttagtaatcggaactctagtatgggcaaagatggcctttcaaattctgttggtgatgttgttccaaatatgagttcagcttcacagggtcctggtcctccacaagatattttgctcaagttgaggatggcccaattccaacagcaacagcagcagcagcagcagcagcagcaacagcatactggtaatccacaactgtcgcaacagcagcagcttcctcaacacacactttctggtccgcaaccacagagttcaaatcacagtctgcaacaagataaaattattggccctggcagtgtgcagaatggaagcatgtcaaatcttttcggggaaatgatcaggcttcaaaa

SEQ ID NO: 2000 - DNA, 201 bp, Nicotiana tabacum
gtggcggacgcggtggaggatactgccgctatggttgttgcggccgcccggaattattatggttgcagcaggtgctgctcctacaaaggtgaggccatccatggataaggtcacctgaagctttgtactcgcaagatgtaatagtaataatcttgcagctttagagcttgttgttaacaagttatgaataaaattaagtca

SEQ ID NO: 2001 - DNA, 257 bp, Nicotiana tabacum
gtctgggaatgctttggagtgcgagtatagtgcgcgtcagctacctaacttgtatttatagattccaagtatatgctgggtctgtgttcagagtagcatgaacaggcctttcctgtttgttgaatttacctcatatgtttattgcagcaggaacttgagttgagacattagagattgctggtatatatttttaagagcttgctcgttttgtacatgtttcttttagagtaggaccttaccgttgatttcccttcaaa

SEQ ID NO: 2002 - DNA, 321 bp, Nicotiana tabacum
gctgcgcaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgagactcttgtggcaaatgcttaagggtgacaaatacaggcacaggagctcagaccacagtgagaatcgtggatcaatgcagcaatggcggactagacttggacgttaacgttttccggcagctcgacacagacggaagagggaatcaacga

SEQ ID NO: 2003 - DNA, 269 bp, Nicotiana tabacum
tttgaagggaaatcaacggtaaggtcctactctaaaagaaacatgtacaaaacgagcaagctcttaaaaatatataccagcaatctctaatgtctcaactcaagttcctgctgcaataaacatatgaggtaaattcaacaaacaggaaaggcctgttcatgctactctgaacacagacccagcatatacttggaatctataaatacaagttaggtagctgacgcgcactatactcgcactccaaagcattcccagacacccccgccccc

SEQ ID NO: 2004 - DNA, 245 bp, Nicotiana tabacum
tcggagaagtatagtcaaattactgtgaaaaaacatatactactaatatttctcataccaaacataaacaatacatgcaaaattagttctctaaaaatccaataaagaagtttatgcccaattgaaccaagtgctttcgactgctgcaagtcaattccagcatgtgattatcaaaattgcataaaaactagctacaataaagataagatcaatctaagagaagcttgagctacggggtgcacccc

SEQ ID NO: 2005 - DNA, 305 bp, Nicotiana tabacum
cgggtacgctctgctctctcgcgacccctactctaatcaaaagactaaaggcccctactgaagataggtcgccaaactacgaccgagagtttcgccttttgaagcgccagtcgcgtagggcgaccgggccaggccgagtcggataaggctttgatgactcaaggttcatattggggaaaggagagtgaggggaagagggggcagccctcggcccgatcatccaattgcgctccaacagacaggcatggttctgtagatcaaagcaacttcgtcactattcgtgtacctcggccgcgaccacgcta

SEQ ID NO: 2006 - DNA, 330 bp, Nicotiana tabacum
gtgtcatgggatccaaatcacaagccagaaccaaggcgaaagagagggttctcgccaaggaagcagcacagagaatgaactagagcttctatttatgttgctgtttgggttagacctacaaattttgtgtttttgattcgcatgcttgagcgatgttagagatcctacgtggattagacttatattttctttgtttacatatttatgtttctatgcaaaagacttgtctaatttttcggttttcggaatagatggttggttgagttggttatgtacgatggataaaatgggaaggctcttccattcactaggtgcttattcttctgataa

SEQ ID NO: 2007 - DNA, 295 bp, Nicotiana tabacum
gtgctgcagttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttggtaatagcaccctttataaggagatttttgatctgtttgtcacaattaaatgtaatcttgaggttatgatttatgaacatctgtcatgtcagtaattgctacttaaaa

SEQ ID NO: 2008 - DNA, 477 bp, Nicotiana tabacum
gtgctgcgcaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgagactcttgtggcaaatgcttaagggtgacaaatacaggcacaggagctcagaccacagtgagaatcgtggatcaatgcagcaatggcggactagacttggacgttatacgttttccggcagctcgacacagacggaagagggaatcaacgtggccaccttattgtgaactacgagtttgttaattgtggtgacaatatgaatgttctggtatccccagttgacaaggaataagaagctatatatggccatgtttagtctttgacggcccaaataaaagtaaaaagaacgatatgtaaaatggat

SEQ ID NO: 2009 - DNA, 440 bp, Nicotiana tabacum
  modified_base (358)..(358): a, c, g or t
gtgctgcgacaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgagactcttgtggcaaatgcttaagggtgacaaatacaggcacaggagctcagaccacagtgagaatcgtggatcaatgcagacaatggcggactagacttggacgtaacgttttccggcagctccgacacagacggaggagggaatcaacgtggccaccttattgtgaactacgagtttgttaantggtggtgacaatatgaatgttctggtatccccagttgacaaggaataaagaagcctatatatggccatgtaagtctttgat

SEQ ID NO: 2010 - DNA, 376 bp, Nicotiana tabacum
tcatattgtcaccacaattaacaaactcgtagttcacaataaggtggccacgtcgattccctcttccgtctgtgtcgagctgccggaaaacgttaacgtccaagtctagtccgccattgctgcattgatccacgattctcactgtggtctgagctcctgtgcctgtatttgtcacccttaagcatttgccacaagagtctcggccacgatggtccaacagggccacaaaatgcagtccaaccatacttcctcctccatgccaaaggcttgttaccatcccaagttgagcagtacgcactaactgcatacaaatcccacccaacattctgcgggttatatatatgatatgttgccctaacgttttgcgcagcacccc

SEQ ID NO: 2011 - DNA, 350 bp, Nicotiana tabacum
gtgctgcgcaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgagactcttgtggcaaatgcttaagggtgacaaatacaggcacaggatgctcagaccacagtgagaatcgtggatcaatgcagcaatggcggactagacttggatcgttatatcgttttccggcagctcgacacagacggaagagggaatcaacgtggccaccttattgtgaactacga

SEQ ID NO: 2012 - DNA, 292 bp, Nicotiana tabacum
gtagcaattactgacatgacagatgttcataaatcataacctcaagattacatttaattgtgacaaacagatcaaaaatctccttataaagggtgctattaccaagtttcatcaattctctaaaaaggaaccaaatatcatactgaaaggagctcctagtcaaacagactgaaccccatgtcgtcatcactttcttccttgggctcttccttcttttcctctgcagcaggggcagctgctgcagcaccagcaccaccaccagcgggagcagcaacagcaactgcagcacccc

SEQ ID NO: 2013 - DNA, 172 bp, Nicotiana tabacum
gccttgtataatgatggttgatagtggtggtagtggttggttatagtggctggtagtggtagtactggtggttggtagtggtaatagtgattgttgtgcaatgatggctggtggtgattgtggacagaatggtggtgaaagttgatttcggaaaatctttaattcaatagta

SEQ ID NO: 2014 - DNA, 511 bp, Nicotiana tabacum
gtatccttatggagtacatgaacgtcggcacactagaaagtcttttaaaatcacaagcaactttctccgaacttagcttagcaaaaatcgctaagcaagtacttagcggactcgactacttacacaatcacaaaatcattcacagagatttaaaaccttcggaccttctagtaaatcgcgagatggaagtaaaaatcgccgatttcggagtgagtaaaatcatgtgcaggactttagatccttgcaattcatacgttggaacttgtgcttatatgagcccagaaaggtttgatccagacacttatggagttaactacaacggttacgcagctgatatttggagtttgggcttgactttaatggaactatatatgggccactttccgttcttgccacctggacagagatcggactgggctacgctaatgtgcgccatatgcttcggtgagccgcccagtttgcctgaagggacgtcgggaaatttcagagatttatcgagtgttgtttacaa

SEQ ID NO: 2015 - DNA, 425 bp, Nicotiana tabacum; identical to SEQ ID NO: 1959

SEQ ID NO: 2016 - DNA, 442 bp, Nicotiana tabacum
cggactcttccgattacctcccataattgcttccctgcccttgaaattgtataatttaatgtgacatccgttggttttccagtgttcaggagtgaactacttacaacaaaactggatatggttttgagaaagggataatgtcactgcaagggtatttaatgtttcagatctgtggttggaattggaaactaatgttgctgcagctggtatgaacctccatagatttgtttcaagataatgaatgtgctaacgtagagatcaatgtttgacctgtttttctttcttattttctgttttgcccattcctggattgcgtgcttgggtttgcttgctttttgtttctttttccattcaacgtttttgtcctaccattccatgtattgtggacacggttagaaacccaaaacaatattttataatactaaacgaagatacttcgaga

SEQ ID NO: 2017 - DNA, 283 bp, Nicotiana tabacum
gtagagtgtttggattggcttttaacatggtcaaatcagcttttaagctctttctagcttttttcagtgtttgacaaagttaaaaaatacttaaaataagttaaaaactgcttaaaagttaaaacaagccaaaccagtaagctagcaaccccaacttattgctttttggcataaaagttatttatgcctaaagactacttttttagctatcattcgcgccttgtaacattaatttgtagagtgcaaagcctcctctgtggcagccgggcatatccgccgccca

SEQ ID NO: 2018 - DNA, 562 bp, Nicotiana tabacum
  modified_base (19)..(19): a, c, g or t
cgcgagcgtacagctacantggggtcgggtggggttgcttttcttcaccctgaaagcaacagtgacgaaaaagcttatatgtgcctatataggataacgcttgagcaatttaatgatgtttacttcaagagaatgtttcgaactttgacatgaactcccctttatttgacatgactgacttacaatctattgaaaacagcaaatgtgtttcagcagaggctgtcaagatgccgactctcagatattgataacttcaaatcaggtaacgtacttacgtgcaaaccatctaaagaatatgccaataatctgattagagggttggtagaaggaaagcagctctcggaagaggaagccaccacttacatacaagaagcagctagcagagcattgtgagttgtgactacgttttccttcttgtttctttagctgctagataattatgtgactatgcctcacaacatatgctccggaactgttattgtaccattattttttgatgaagcaactgctatcatttttttcagtccaggtgtatataacttataacatctgacatagatgt

SEQ ID NO: 2019 - DNA, 374 bp, Nicotiana tabacum
cgcatcctttaccccaaactcaccggaaaaacttgccaacccggcgagttaactcatggtccccctttcccttctctctttcttccacgtggcctgacaaataaccgattttggttcgaatctacgttgtattttgctctctcatacgtgaatctctttcaacgatagatgatggacgaagggtaggatatgattaatgaaaattaatcatacccctccatttgtccagatttttaccaaaaagaaggaaattttcagaattttggtgggattttcggatttttgaagggtttttgctatttcttgcaaaggaaggagagaagcttcgagagagggctatatatttgggtctggacagagattgaaagggggta

SEQ ID NO: 2020 - DNA, 381 bp, Nicotiana tabacum
gtcacgtatctatagaaacatataccaaagcagaagctcaaaactaaagctctaactaataattctacgttcaacatgtaagcaagaccttgcattactaaccccaacattacatctattcccttaatatcatatgctacgcgcaagaagtgcacataggcacagaaatatccggtgcagcctagcagtagagcaggatacccataattgaaatccaaaaggtgacgcaaggctgctgcagttaccagaggaatgacctcgatcataaatttagccttggcaccaattaactggaaaggcatgtcgcgatgccaataaacaacagagtacagcacattgatatgaagtaaaaagcaacaacccgggcaaatccgccgccca

SEQ ID NO: 2021 - DNA, 354 bp, Nicotiana tabacum
aaagaatgaattaaatagcttttatttactaacaattacacaattagtgatccccttctcctagtaagcttctaatccatacaagactccagcgtgtttttctggcccgtcttttacgaaataaatatccctcattttctgaaatgcatgccacgtcaacaagctatctgaaccggcctggtggcatttaccgaccgctctgtccacagccaatgtactcgcaactcggtctaacccaccaaagaggctattacagaacctcatcatatgcttcacatcataaactttgtttccaaaaaacgccctaagaatttccaaaaagtcctctaaaccaccgggcaaatccgccgccca

SEQ ID NO: 2022 - DNA, 393 bp, Nicotiana tabacum
cggtgtttcaattgccatcatgggttgcattgtgaatggacctggggaggtggctgatgctgacttcggatatgttggtggtgctcctgggaagattgacctttacgtcggcaagacggtggttaaacgcggtattcaaatggagcatgcaacagatgccttgatccagctaattaaagataacggccgctgggtggatcctcctgctgaggagtaagatcaactggaagagttaacagataacaattgcattgtaaatgcagattctagcacctgataataatacagcatcagcaaactccagaaagctgccatttccaaccagctgagatgtagctttttatgttgtttgtagaatctagtacatgcatgcaaatgcagaatattcatgta

SEQ ID NO: 2023 - DNA, 234 bp, Nicotiana tabacum
  modified_base (107)..(107): a, c, g or t
cgtccggaatcctcttcagagagaactacaactgcccggcaagagagccgtacaccccacgctactacatcaactagactcgttccttagcggatattcgatgtttnaagaagaaccaggcgacaacgaaatgggagaaacatagaaattgagattaatcgcaaactatgaaaatatgcttgaaaaaagtaaaaagaaagaaactcgaaataaaaaaaggttcaaacagcaaaa

SEQ ID NO: 2024 - DNA, 365 bp, Nicotiana tabacum
cacctaattctaatagcttttgctcatataagttcacatctgttataaatatttaattaagaaaaatcttgagtccgccctctgtatgctaagccttttggaataaaatcttgaaaaccggacgattgacagccaaacgcctcgatccattattcgctggtgcaataccaatatacccacacaacaatcttggacaaataaaagaacaccctgtagctcttggacaatactgtaacgcataggcatcttcatacttctgaatagtaaacaaacttgtggccgtgccattttcagacccacccttaattccgccagtggtcacaaacccatcttcaattttccaaacagtggttttattgcaaata

SEQ ID NO: 2025 - DNA, 402 bp, Nicotiana tabacum
attaagaaaaatcttgagtccgccctctgtatgctaagccttttggaataaaatcttgaaaaccggacgattgacagccaaacgcctcgatccgttattcgctggtgcaataccaatatacccacacaacaatcttggacaaataaaagaacaccctgtagctcttggacaatactgtaacgcataggcatcttcatacttctgaatagtaaacaaacttgtggccgtgccattttcagacccacccttaattccgccagtggtcacaaacccatcttcaattttccaaacagtggttttattgcaaatagacacgtatcttggtgctgcaaatttgatatttatgtcttcattttcgtcaattactagccctgaacttgaattcaccattaagaattttaa

SEQ ID NO: 2026 - DNA, 313 bp, Nicotiana tabacum
aaattcttagggcgttttttggaaacaaagtttatgatgtgaagcatatgatgaggttctgtaatagcctctttggtgggttagaccgagttgcgagtacattggctgtggacagagcggtcggtaaatgccaccaggccggttcagatagcttgttgacgtggcatgcatttcagaaaatgagggatatttatttcgtaaaagacgggccagaaaaacacgctggagtcttgtatggattagaagcttactaggagaaggggatcactaattgtgtaattgttagtaaataaaagctatttaattcattctt

SEQ ID NO: 2027 - DNA, 341 bp, Nicotiana tabacum
tttagaggactttttggaaattcttagggcgttttttggaaacaagtttatgatgtgaagcatatgatgaggttctgtaatagcctctttggtgggttagaccgagttgcgagtacattggctgtggacagagcggtcggtaaatgccaccaggccggttcagatagcttgttgacgtggcatgcatttcagaaaatgagggatatttatttcgtaaaagacgggccagaaaaacacgctggagtcttgtatggattagaagcttactaggagaaggggatcactaattgtgtaattgttagtaaataaaagctatttaattcattctttttaattgaaaa

SEQ ID NO: 2028 - DNA, 325 bp, Nicotiana tabacum
ttttggaccagaaacagtcagaactatgtcaacataaatgatttaaaaagttgcagcaggacaaaaggaagggaaaaaacaatgatccagaacatgcgagggagtacttgtacaccagcagcagttaataaaattctacagcctcaaacatgtcagtaggggcatactcttgtttcaactgaccattggatcaggacttgatgcagacacaacatccagcagtgagttcacaggctctaattcttcatgccaaagttggagggaatcacctggatagaactttcttgtggctccatctttgttaatagttacagtccgggcagct

SEQ ID NO: 2029 - DNA, 330 bp, Nicotiana tabacum
ccatggcggccgcgggaatgcgattgggaggcgggcgtgttccggggcgtaagtcccgactgccgaggtgtaagtctcacggaactaagccccacacataagtcccggggcgttttacgagtgctccgctccagggcgagccccgggcgagtcccaattctgccttttaaaacagagctaattactatagtacaaagtaattttattctgtgcagtggagcatgaagtactcgaaagagaaagaggaagactacgagcattatatcagcaacagcaactgccacagtcacagcagcaacagcagtcatcttccagccatcggcgcagcac

SEQ ID NO: 2030 - DNA, 322 bp, Nicotiana tabacum
tcttaatggagggatcagataaagaaggtttcgatataacaggaagtagagagatcaagatgatgccatttggcgctggtaggagaatatgcccaggctatgctttggctatgcttcatttagagtactttgtggctaatttggtttggcattttcgatgggaggctgtggagggagatgatgttgatctttcagaaaagctagaattcaccgttgtgatgaagaatccacttcgagctcgtatctgccccagagttaactctatttgaatttggtaattactagttctttctatttgcgttgttccctgttgatggactta

SEQ ID NO: 2031 - DNA, 256 bp, Nicotiana tabacum
ggtttggcaacgaaatgggcggacaagctggtgctcagcatgtgcagccaatgccagttgaaaatccaagtaaaagagtttactgttctgtggtggagtgaagcccaggggttggtagctattgtgcttcaagcaatcaatgagtatagtcattactgttgccgatggcaatgacgtatcaggaaatagacacacaataaacgagaacagaatggggaaaggaattatactggcatttaagctggcagcttgattt

SEQ ID NO: 2032 - DNA, 599 bp, Nicotiana tabacum
caatacgcaaaccgcctctccccgcgcgttggccgattcattatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatccaacgcgttgggagctctcccatatggtcgacctgcaggcggccgcgaattcactagtgattttcaagccggagaggtttgcaaaaatggccatagagttgttgggctattcgcaaataaatgagcaattagctctacaagaagcagcttcagccggtttaaattccatggatcatttaatccggttcgtttcacatcaacagcagaaaaaccaaccagttcagcccgattgtagacaactcgccgacttcgctgtttcgaattttaagaaggttatttctatcttgaaccggactggtcatgcccggtttagacgcagtccggttcaatc

SEQ ID NO: 2033 - DNA, 323 bp, Nicotiana tabacum
taaaaggaaaagaaaatacttatccctgacaaaacaaaattcatatcccaacaaaatcaagctgccagcttaaatgccagtataattcctttccccattctgttctcgtttattgtgtgtctatctcctgatacgtcattgccatcggcaacagtaatgactatactcattgattgcttgaagcacaatagctaccaacccctgggcttcactccaccacagaacagtaaactcttttacttggattttcaactggcattggctgcacatgctgagcaccagcttgtccgcccatttcgttgccaaaccgctccggcttgaaa

SEQ ID NO: 2034 - DNA, 325 bp, Nicotiana tabacum
tctactaggaaataaagtgaaatgtgcagatggcaaggcttgtacacggaattgcgatccagatgtagcttacatggtttgcccatctactcgacaaaagattactaaaccatgtgtcaactgttgctcagcaaaaaaaggttgcaagcttttccgcagcaatggatctgtaaaatgtactggaacttagcttttgtccattattaataagctagctacaaggccactacttaggatatctgtgcaataaggcttgacaatatataagttctcacgtgtgatttgtactatatattgagtatggtatttcattccttgttcaata

SEQ ID NO: 2035 - DNA, 327 bp, Nicotiana tabacum
ttggcaacgaaatgggcggacaagctggtgctcagcatgtgcagccaatgccagttgaaaatccaagtaaaagagtttactgttctgtggtggagtgaagcccaggggttggtagctattgtgcttcaagcaatcaatgagtatagtcattactgttgccgatggcaatgacgtatcaggaaatagacacacaataaacgagaacagaatggggaaaggaattatactggcatttaagctggcagcttgattttgttgggatatgaattttgttttgtcagggataagtattttcttttccttttatgttatgttgttcctccaaaa

SEQ ID NO: 2036 - DNA, 570 bp, Nicotiana tabacum
tccgcactataacaagtagttactatcggggagcacatgggattattattgtttatgatgtaacggaaatggagagcttcaacaatgtcaagcaatggttgaatgaaattgacagatacgcaaatgagagtgtttgcaagcttctggtgggaaacaaatgtgatttggtagaaaacaaggttgtggacacacagacgggaaaggctctggcagatgagctaggtatccctttccttgagacgagtgcaaaagactccattaacgtggagcaggctttcttaacgatggcgggagagatcaagaaaaaaatgggtaatcaaccagctggagccaagaagacaggtagtactgttcaaatcaaaggacaaccaattgagcagaagagcaactgctgtggctaactgctgacgctgtgcttctgtatcccctctaatcactagtgaatccgcggccgcctgcaggtcgaccatatgggagagctcccaacgcgttggatgcatagcttgagtattctatagtgtcacctaaatagctgggcgtaatcatggtcatagctgtttcctgtgtgaa

SEQ ID NO: 2037 - DNA, 566 bp, Nicotiana tabacum
acttagattataattttagacatagtaggagcttcgagaaagtaaatagattgtgaagaaacattaacgtcatggaaaagattaattcctcctccctcatcatcctatcttcgttactgccaatttcttaagaaccacaacaagctgatttttgggcagtttgagcacctcctgctccctggtcgggttgattaatcctgatggtctgaggctcggctctattgtcagattcagcaagtctttgttttatatcccgagctattgaaaagaaaacctcctcaacattcatattcgtcttggcactcgtctcaaagaatttaatgccatattcatcggctagcgcttgacccttggatgtaggaacagcccgtttgctttcatccatatctgccttgtttcccacgagtattttattgacattgtcagaagcatgttgttcaatgtttcgtatccaattcctgatgttgttaaacgatgactcgtcagtcacatcatataccagcaagatacccatggctccacggtagtaagctgttgtaattgttcggaaccgctccggctcgaaa

SEQ ID NO: 2038 - DNA, 564 bp, Nicotiana tabacum
  modified_base (546)..(546): a, c, g or t
agctgaaattttattattagtttcaacaactattacattcagcttgaaaaggcccttagtaaggtaacctttttcctacaaacatttcattcttactaatcactaccttgtcagatacaaaaacgcacttgaaaccatgctttacaagaagtccagtaaagactaagttcttcctaatctcgggaacatgaaggacgttgttcaaagtcatgaccttgccagaagtcatcttgagaaatatcttaccgtatccttcaatgtttgttgtagcagcatttcccatagagagcttctcttcgggtccagcagaagcatatatagaaaatacttccctcacggcacaaacatggtgagtggctccagaatcaatccaccactcctttgggtttcctaccaggttgcattcagaaagcatggcgcacaagtcatcaacatcatcatgcttttctaccatgtttgcttgacccatttgcttgtctttcttccgagcacaacacttcgtagatttgtgtccggttttcccacagttgtagcagtttccactgnaaccgctccggctcgaaa

SEQ ID NO: 2039 - DNA, 258 bp, Nicotiana tabacum
ttcgagatgctgctagggaggctgctcttcgtgaaatcaaggaaagaatcaagaagacaaaggatgaaaagaaggctaagaaagcagaggtgatggcaaagtcacagaaaggtggagggaagggtaatgtgtcaaagggagctgcaggaaaaggccctaagcttggcggcggcggtggaaaacgctaagccattgtttatgtttgtttttctaagtagtactagagtggtttttgcatcttgattgaatgtaagttta

SEQ ID NO: 2040 - DNA, 412 bp, Nicotiana tabacum
aacaattacaacagcttactaccgtggagccatgggtatcttgctggtatatgatgtgactgacgagtcatcgtttaacaacatcaggaattggatacgaaacattgaacaacacgcttctgacaatgtcaataaaatactcgtgggaaacaaggcagatatggatgaaagcaaacgggctgttcctacatccaagggtcaagcgctagctgatgaatatggcattaaattctttgagacaagtgccaagacaaatatgaatgttgaggaggttttcttttcaatagctcgggatataaagcaaagacttgctgaatctgacaatagagctgagcctcagaccatcaggattaatcaagccgaccagggagcaggaggtgctcaaactgcccaaaaatcagcttgctgtgga

SEQ ID NO: 2041 - DNA, 247 bp, Nicotiana tabacum
agatgctgctagggaggctgctcttcgtgaaatcaaggaaagaatcaagaagacaaaggatgaaaagaaggctaagaaagcagaggtgatggcaaagtcacagaaaggtggagggaagggtaatgtgtcaaagggagctgcaggaaaaggccctaagcttggcggcggcgatggaaaacgctaagccattgtttatgtttgtttttctaagtagtactagagtggtttttgcatcttgattgaatga

SEQ ID NO: 2042 - DNA, 248 bp, Nicotiana tabacum
gagatgctgctagggaggctgctcttcgtgaaatcaaggaaagaatcaagaagacaaaggatgaaaagaaggctaagaaagcagaggtgatggcaaagtcacagaaaggtggagggaagggtaatgtgtcaaagggagctgcaggaaaaggccctaagcttggcggcggcgatggaaaacgctaagccattgtttatgtttgtttttctaagtagtactagagtggtttttgcatcttgattgaatga

SEQ ID NO: 2043 - DNA, 262 bp, Nicotiana tabacum
gcacgacaggtttccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatccaacgcgttgggagctctcccatatggtcgacctgcaggcggccgc

SEQ ID NO: 2044 - DNA, 192 bp, Nicotiana tabacum
ttaatggagggatcagataaagaaggtttcgatataacaggaagtagagagatcaagatgatgccatttggcgctggtaggagaatatgcccaggctatgctttggctatgcttcatttagagtactttgtggctaatttggtttggcattttcgatgggaggctgtggagggagatgatgttgatctttca

SEQ ID NO: 2045 - DNA, 460 bp, Nicotiana tabacum
tccgaacaattacaacagcttactaccgtggagccatgggtatcttgctggtatatgatgtgactgacgagtcatcgtttaacaacatcaggaattggatacgaaacattgaacaacatgcttctgacaatgtcaataaaatactcgtgggaaacaaggcagatatggatgaaagcaaacgggctgttcctacatccaagggtcaagcgctagccgatgaatatggcattaaattctttgagacgagtgccaagacgaatatgaatgttgaggaggttttcttttcaatagctcgggatataaaacaaagacttgctgaatctgacaatagagccgagcctcagaccatcaggattaatcaacccgaccagggagcaggaggtgctcaaactgcccaaaaatcagcttgttgtggttcttaagaaattggcagtaacgaagataggatgatgagggagga

SEQ ID NO: 2046 - DNA, 398 bp, Nicotiana tabacum
ttggcactgcatctgcagctcagggatcagatgctttaaagaaatcggaggagcagaagaggaaggctagagctgagaggtttgggcttaaccaatcagatagtgctgacgaggaagctaagaagagagctaggttggcaaggtttacatctaccgcgaaggctgatcctgtagaggaagacaagaggaaagctagggccctcaggttttcacaatcccagtctggttcccaatcacaagagaatggcaaaggaaaaattgagcaggatactgttgtggtggagaaggccggaggaggaacataaaccactctcaaacttcgttcaacagtgaggcttgcttataatgtatagcttattgttgctgcgcagtgtaggagttttctttagagtgacttt

SEQ ID NO: 2047 - DNA, 392 bp, Nicotiana tabacum
cgtaacagaggatgcacccacaattgatcagtagtctgcggggaatcaatagctgcatttttaactaaatgcaaaattgtatacgagaaacttttgtctgcagatgtaacttttgtaaatgattggtcgtttacagtgtcttcaaacaagccactctattgctaataaggaaacaaaatgaacagcagcttaacgttttcctccgccaccgccaagcttaggaacttttgatgcacctcctttggggaggttgccctttcctccagctttctgggacttggccgtcacctctgctttcttagccttcttttcatcctttgtcttcttaatcctttccttaatttcacgaagagcagcctccctggcagcatctcgaactcgtggccgttcaa

SEQ ID NO: 2048 - DNA, 543 bp, Nicotiana tabacum
agtaggagcttcgagaaagtaaatagattgtgaagaaacattaacgtcatggaaaagattaattcctcctccctcatcatcctatcttcgttactgccaatttcttaagaaccacaacaagctgatttttgggcagtttgagcacctcctgctccctggtcgggttgattaatcctgatggtctgaggctcggctctattgtcagattcagcaagtctttgttttatatcccgagctattgaaaagaaaacctcctcaacattcatattcgtcttggcactcgtctcaaagaatttaatgccatattcatcggctagcgcttgacccttggatgtaggaacagcccgtttgctttcatccatatctgccttgtttcccacgagtattttattgacattgtcagaagcatgttgttcaatgtttcgtatccaattcctgatgttgttaaacgatgactcgtcagtcacatcatataccagcaagatacccatggctccacggtagtaagctgttgtaattgttcggaaccgctccggctcgaaa

SEQ ID NO: 2049 - DNA, 251 bp, Nicotiana tabacum
atcctcgagaaattatgccatatttctcgataagttgtgttcgacctctaatcgactgctctatgacgatttttctgttttcttagtgcttttgctcagtaaataataattgaaaattgatatatttttcatttttttccaaaataattaccatctggttactccattactctcttccggtacccaagttctactgctcctcctcaaatatctactgaatactgaagtgcttgaaccgctccggctcgaaa

SEQ ID NO: 2050 - DNA, 374 bp, Nicotiana tabacum
agttcgagatgctgccagggaggctgcttttcgtgaaattaaggaaaggattaagaagacaaaggatgaaaagaaggctaagaaagcagaggtgatggccaagtcccagaaagctggaggaaagggcaacctccccaaaggaggtgcatcaaaaggtcctaagcttggtggcggcggaggaaaacgctaagctgctgttccttttgtttccttattagcaattagagtggcttgtttgaagacactgtaaacgaccatcatttacaatagttacatctgcagacaaaagttactcgttgacgattttgcagttagttaaaaatgcagctattaattccccgtagactgctgaccagttgtgtgggtgcattcta

SEQ ID NO: 2051 - DNA, 347 bp, Nicotiana tabacum
tcgagatgctgctagggaggctgctcttcgtgaaatcaaggaaagaatcaagaagacaaaggatgaaaagaaggctaagaaagcagaggtgatggcaaagtcacagaaaggtggagggaaaggtaatgtgtcaaagggagctgcaggaaaaggccccaagcttggtggcggcggtggaaaacgttaagctattgtttatgtttgtgtttctaagtagtactagaatggttttgcatcttgattgaatgtaagtttttgatccaactgcagatcagcagttcaaacaaatatatttctgaattttggtcttgtttcaaatatgcagattaattactcttgttcccaaa

SEQ ID NO: 2052 - DNA, 248 bp, Nicotiana tabacum
tccgaacaattacaacagcttactaccgtggagccatgggtatcttgctggtatatgatgtgactgacgagtcatcgtttaacaacatcaggaattggatacgaaacattgaacaacatgcttctgacaatgtcaataaaatactcgtgggaaacaaggcagatatggatgaaagcaaacgggctgttcctacatccaagggtcaagcgctagccgatgaatatggcattaaattctttgagacgaga

SEQ ID NO: 2053 - DNA, 306 bp, Nicotiana tabacum
tctactaggaaataaagtgaaatgtgcagatggcaaggcttgtacacggaattgcgatccagatgtagcttacatggtttgcccatctactcgacaaaagattactaaaccatgtgtcaactgttgctcagcaaaaaaaggttgcaagcttttccgcagcaatggatctgtaaaatgtactggaacttagcttttgtccattattaataagctagctacaaggccactacttaggatatctgtgcaataaggcttgacaatatataagttctcacgtgtgatttgtactatatattgagtatggta

SEQ ID NO: 2054 - DNA, 215 bp, Nicotiana tabacum
cacgagttcgagatgctgccagggaggctgctcttcgtgaaattaaggaaaggattaagaagacaaaggatgagaagaaggctaagaaagcagaggtgacggccaagtcccagaaagctggaggaaagggcaacctccccaaaggaggtgcatcaaaagttcctaagcttggcggtggcggaggaaaacgttaagctgctgttcattttgtttca

SEQ ID NO: 2055 - DNA, 356 bp, Nicotiana tabacum
ttggcactgcatctgcagctcagggatcagatgctttaaaggaatcggaggagcagaagaggaaggctagagctgagaggtttgggcttaaccaatcagatagtgctgacgaggaagctaagaagaaagctaggttggcaaggtttacatctaccgcgaaggctgatcctgtagaggaagacaagaggaaagctagggccctcaggttttcacaatcccagtctggttcccaatcacaagagaatggcaaaggaaaaattgagcaggatactgttgtggtggagaaggccggaggaggaacataaaccactctcaaacttcgttcaacagtgaggcttgcttataatgtatagcta

SEQ ID NO: 2056 - DNA, 312 bp, Nicotiana tabacum
ttcgagatgctgccagggaggctgctcttcgtgaaattaaggaaaggattaagaagacaaaggatgaaaagaaggctaagaaagcagaggtgacggccaagtcccagaaagctggaggaaagggcaacctccccaaaggaggtgcatcaaaagttcctaagcttggcggtggcggaggaaaacgttaagctgctgttcattttgtttccttattagcaatagagtggcttgtttgaagacactgtaaacgaccaatcatttacaaaagttacatctgcagacaaaagtttctcgtatacaattttgcattta

SEQ ID NO: 2057 - DNA, 310 bp, Nicotiana tabacum
tccgaacaattacaacagcttactaccgtggagccatgggtatcttgctggtatatgatgtgactgacgagtcatcgtttaacaacatcaggaattggatacgaaacattgaacaacatgcttctgacaatgtcaataaaatactcgtgggaaacaaggcagatatggatgaaagcaaacgggctgttcctacatccaagggtcaagcgctagccgatgaatatggcattaaattctttgagacgagtgccaagacgaatatgaatgttgaggaggttttcttttcaatagctcgggatataaaacaaag

SEQ ID NO: 2058 - DNA, 250 bp, Nicotiana tabacum
tcgagatgctgctagggaggctgctcttcgtgaaatcaaggaaagaatcaagaagacaaaggatgaaaagaaggctaagaaagcagaggtgatggcaaagtcacagaaaggtggagggaagggtaatgtgtcaaagggagctgcaggaaaaggccctaagcttggcggcggcgatggaaaacgctaagccattgtttatgtttgtttttctaagtagtactagagtggtttttgcatcttgattgaatga

SEQ ID NO: 2059 - DNA, 288 bp, Nicotiana tabacum
tcgagatgctgctagggaggctgctcttcgtgaaatcaaggaaagaatcaagaagacaaaggatgaaaagaaggctaagaaagcagaggtgatggcaaagtcacagaaaggtggagggaaaggtaatgtgtcaaagggagctgcaggaaaaggccccaagcttggtggcggcggtggaaaacgttaagctattgtttatgtttgtgtttctaagtagtactagaatggttttgcatcttgattgaatgtaagtttttgatccaactgcagatcagcagttcaaacaaa

SEQ ID NO: 2060 - DNA, 290 bp, Nicotiana tabacum
tcaagcacttcagtattcagtagatatttgaggaggagcagtagaacttgggtaccggaagagagtaatggagtaaccagatggtaattattttggaaaaaaatgaaaaatatatcaattttcaattattatttactgagcaaaagcactaagaaaacagaacaaatccgtcatagagcagtcgattagaggtcgaacacaacttatcgagaaatatggcataatttctcgaggattatctatcgagtttcaaacagttggcgagacgattttcggtgataagagaatta

SEQ ID NO: 2061 - DNA, 373 bp, Nicotiana tabacum
tccgaacaattacaacagcttactaccgtggagccatgggtatcttgctggtatatgatgtgactgacgagtcatcgtttaacaacatcaggaattggatacgaaacattgaacaacatgcttctgacaatgtcaataaaatactcgtgggaaacaaggcagatatggatgaaagcaaacgggctgttcctacatccaagggtcaagcgctagccgatgaatatggcattaaattctttgagacgagtgccaagacgaatatgaatgttgaggaggttttcttttcaatagctcgggatataaaacaaagacttgctgaatctgacaatagagccgagcctcagaccatcaggattaatcaacccgaccaggg

SEQ ID NO: 2062 - DNA, 563 bp, Nicotiana tabacum
tccgaacaattacaacagcttactaccgtggagccatgggtatcttgctggtatatgatgtgactgacgagtcatcgtttaacaacatcaggaattggatacgaaacattgaacaacatgcttctgacaatgtcaataaaatactcgtgggaaacaaggcagatatggatgaaagcaaacgggctgttcctacatccaagggtcaagcgctagccgatgaatatggcattaaattctttgagacgagtgccaagacgaatatgaatgttgaggaggttttcttttcaatagctcgggatataaaacaaagacttgctgaatctgacaatagagccgagcctcagaccatcaggattaatcaacccgaccagggagcaggaggtgctcaaactgcccaaaaatcagcttgttgtggttcttaagaaattggcagtaacgaagataggatgatgagggaggaggaattaatcttttccatgacgttaatgtttcttcacaatctatttactttctcgaagctcctactatgtctaaaattataatctaagtcttggcttattatt

SEQ ID NO: 2063 - DNA, 326 bp, Nicotiana tabacum
acgtttatctttctatagaaactaaatatccagtgacaatcaacttagggccgcaacagattatatacactccagccctgctgcgtgcccaaagaaaagaagatgcacaacttggatccatgcaagttttggttcatatcaaaatgatggaagtcaccaatccatctccataccatgccatgtggtcatctcaaagggacaaccgataggctcatgcactaattatctatgtagaattgggagagcacatgcaagagaagcatgatttccctccttgtatacaagatttccgcgcacaaaggttgccaaacctttccggctcgaaa

SEQ ID NO: 2064 - DNA, 288 bp, Nicotiana tabacum
tcaagcacttcagtattcagtagatatttgaggaggagcagtagaacttgggtaccggaagagagtaatggagtaaccagatggtaattattttggaaaaaaatgaaaaatatatcaattttcaattattatttactgagcaaaagcactaagaaaacagaaaaatcgtcatagagcagtcgattagaggtcgaacacaacttatcgagaaatatggcataatttctcgaggattatctatcgagtttcaaacagttggcgagacgattttcggtgataagagaatta

SEQ ID NO: 2065 - DNA, 279 bp, Nicotiana tabacum
atggcataccgccacccctagccttggagtaggacacatagtagaactgggagattatgctggtgaagaaaatgaaagctgctccagctgcaaaaactccttttctcagagtttcacaagatagaggcttgtcgttaatcaagtatgatgatcggtacttggtgtgataagcattcctaactgaaccagccaacaagcagacctcagcaatgaagaatgtaacccagcatatgatgaacaagagaacagcacaagcccttgaacctctccggctcgaaa

SEQ ID NO: 2066 - DNA, 394 bp, Nicotiana tabacum
gttctccaaacctatttgccgcctctccttttttctcccaaaacttgccgacactaaacgaaggagagaaacagagagtagcagtagatatggcaggaaaaggtgaaggaccggcgatcggtatcgatctcggaaccacttactcttgcgtcggagtttggcagcacgatcgtgttgagatcatcgccaatgatcaaggaaacagaacgacgccgtcttacgttggattcactgatactgagcgtctcattggcgatgctgctaagaatcaggtcgctatgaaccctatcaacaccgtctttgatgcaaaaaggctgattggtaggagatttgctgatgcctcagtgcagagtgacattaagcattggccatttaaggtcattcctggacctgg

SEQ ID NO: 2067 - DNA, 538 bp, Nicotiana tabacum
actaataggccctgatggtaccgagaacgaaattgaagtgtccgacgatcaatacatccttgatgcagcagaggatgctggtttggagctgccgtactcgtgcagggctggttcttgttgtacttgtgcaggacagttggtttcgggatcagtagaccaatccgaaggtgcattcctcgacgacgatcaaatggagaagggttatttgttgacttgcatttcgtacccgagatctgactgtgttattcatacaaacaaggaggaagaagttcattgaatattgttaatgtgctcattctgttttaaggcaattgcagagttttagtagaaagcttgttctggaaaagggaataggaaaataagaaaccataaagaaatagagttgttctgcatccagatagtaatgtttgtgtctggtttatggcataaattatgtttgtaagttgatatgtggtacttccacttgtattgctttcttgatctgctgaaccaaggattcttgaaacggaaaagggtcaaatatgtccttatactaaaa

SEQ ID NO: 2068 - DNA, 326 bp, Nicotiana tabacum
ctgaaatatggggttttgaagaagggaacaagtgcctgagtcatttacaagaatgcaggacttgcttcaaaaaggctctgatcttagtagcgtctcaacaggcccatcgatcagtgttagacctagctggtggactagcaaagaaccacaaatgcaacaatggttgacttttcctggtcctcaaaatcccgaacagttcggttttcattttcaagatcaggattcctcttctactcagtcgacgggtcaatcatgccctgaagttgctactgaaggagaaagcaaaatctatgggaaaagcaacatgccttttcaagcaggctatt

SEQ ID NO: 2069 - DNA, 545 bp, Nicotiana tabacum
gcacctccaaatgagtggcctgagattgtgggagatgatagatccaacctgcccttaaattcatttagaaacagagtcgaatctaaaagattttctataggaccagcatttatggagtggagcaagtctaaagctttggaacactctttagaccttattttgacctgattgcttttctccgcataatgctgtggaccaactgtaaatttttgatgacggatccatgtgcgttgatcattgttttttgcttcctccgattcataataataggttgcacaagctgagtgatccctgtgctccactgaagccatcacaaaacctctggaagcaagctcgcaacaaaaagtagtacagacaaaccggcaggccccgaatccgtgagagaaaattatcgttttgaacttatcttctttcaagagaggtggtcctttctcaatgacaggtatgtgaagattacctccagaaatgagccagatggaccatttgaggagagagacccagatgctgacgactgaagcgaatccttcctcgtagttgggatgagc

SEQ ID NO: 2070 - DNA, 395 bp, Nicotiana tabacum
tttgtgattccgattagtgtgtaagagagaaattctttgcgaaaactccatttattttttttacgttaagggcgaattccagcacactggcggccgttactagtggatccgagctcggtaccaagcttgatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtat

SEQ ID NO: 2071 - DNA, 502 bp, Nicotiana tabacum
tttgtttggccattcttataatgataagctctgaggttttagctagggagttgtctgagacttccaccacttcagaagaggactcaaagaaatccgataacaagaatgaagtgcatgaagctcaatatggtggcggataccccggtggtggctaccctggcggtggataccctggcggcggataccctggtggcggccgtggtggcggtggataccctggtggcggccgtggtggatacccaggtggcggccgcggtggtggacgtggaggatactgccgctatggttgttgcggccgccgcaattactacggctgcagcaggtgttgctactacaaaggtgaggccatggataaagtgactgaagggaagcctcaacactgatcatcgtgtaatatataaaacctttgtaatggcaaagctgtaatagtaatgctctttctacttcagagcttgctgtattaagtatgaataaaagccattatctaatatgtttgttaaaa

SEQ ID NO: 2072 - DNA, 403 bp, Nicotiana tabacum
tgttgatggacttcccccatatagtactggaagttagagggagaatgattattaatgccttgctgcaatattagcttagtagttagtagtgaatataattgaaactggatatttctatcttatgtgttgtacatttggttcattgcaaagggcgaattccagcacactggcggccgttactagtggatccgagctcggtaccaagcttgatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgcttt

SEQ ID NO: 2073 - DNA, 327 bp, Nicotiana tabacum
tttactttagctcaaagtgtcatcattctttgctttgttcttagcaacaagtttttctttgttttttgattgaaaaaaagaatggccgatcaatatgaaaagaaggttgaagagggtagcgcaaacgtggaggctacagatcgtggtttgtttgatttcctagggaaaaaggaagaggaaaagccaactcatgcccaagaggtacatgctatttcctctaagtttgttgaaaaagtaaaggtttctgaagaagttgcagaatacaaggaagaagagaagaaagaggagcacaacaaagaagagaagaaactccatcgatcaagtagc

SEQ ID NO: 2074 - DNA, 162 bp, Nicotiana tabacum
ttatgacttcatatgctcaggccccctcatcaataagataggtctgacacccgaaaaagtggctgagtccattgataagtggatagagtaaggatttcgcctttgtagatcgtttcagctcaaccagctggctctcaacgagcctcaaaaaattcgactcta

SEQ ID NO: 2075 - DNA, 463 bp, Nicotiana tabacum
gtttttccagttcttttgttttgattccacgcaaaaccccataaaaaaaccaaattacaattatatacaaagcagagaaatttcccaaaaaaggcaagaatattttcgagttcttttttggggggattctgattttcattcaaaaacccatttttaagctttttaacacagacgcaaatcattaggttttcaaagactgtgaatttttacaaagttgagaactttattaaaagagaagaaagcgagagaaaattgggtgtttggtttgatgttttgttgaaatcttcgttgatcacaattcaattcagagacttctgtgaatttacaaaagaattgaaaaaaagagaagataaaaggaggggttttgttattggagttttgatttgcaaatagaaaaagatgggcaggctttgttctgttattctacaaataatgaaaacattctgagagggctcgttatatg

SEQ ID NO: 2076 - DNA, 474 bp, Nicotiana tabacum
tctagtaagtacaactctttgctgcaaatacaaaaaattccgatggcgatgagacgtgtggcttctacagcagctcgtgcttttgcttcctcttcaccatcaccgtcctccttagtttttactagagaacttcaggcttcccctggtagcaaaaagattgttggtgttttctataaagcaaacgaatatgctgaaatgaaccccaactttgtgggctgtgccgaaaatgccttggggatacgcgaatggttagaatctaaaggtcattagtacatagtcactcctgacaaagaaggaccagattgtgagcttgagaaacacattcctgatctccacgtgttgattactactccttttcatcctgcctatgtcacggctgaaaggatcaagaaggcgaaaaatttacaacttctgctgacagctggaattggatcagatcatgttgatctgaaagctgctgctgctgcagggttg

SEQ ID NO: 2077 - DNA, 388 bp, Nicotiana tabacum
acgaaactgcaaaagctggcgtaacatctaaatacgtaactccaaagtcaagttggtcctgtaaagacgcataattcaacgtcttgcgcgacgcccgccacctgacctagcaccaggatggcgagcatattgcagccttaagttgaccgaatcacggtcatgatcgtcgaatttataaccttgtaaggcatccattgcagtagctgcatgggctggactcacaaaatcaacaaagcaaagaaccaagggatgccctcctgggtgtcgtgattctttgatcacaagtctaacttctctgtaacctacaaatggtcgaaatatatgtgacatctctcttcgggtgcaattagctggcaacccttcaacaaacaatgtactgctggcatta

SEQ ID NO: 2078 - DNA, 264 bp, Nicotiana tabacum
ctcttcccctctgctgcctattagcgctagtagagtaggattgacccgtaatacagaacctctaggcgtaacctttcgcttaatactagaatcgagaatcgaaacatagcatctgaggttgcattaatcgaggatacacgacagaaggaattgttctatttccaaacttcaccttcaaaaagcgtagattttttcaaaaattttctcgaatcacgtgtttttctcctcgtaagactgagagaaatgactaaatatgaaataaaa

SEQ ID NO: 2079 - DNA, 355 bp, Nicotiana tabacum
gcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcgg

SEQ ID NO: 2080 - DNA, 279 bp, Nicotiana tabacum
ttttcccttcgtacagaaagttacttgcatttttaaaccaaaacgaacattcatatttttacaggagcttgtcaatgcaatgcagcaaacgataaggcaaacagcaccaagccagaatactagggccaaaacaaacgtgttccaataaaatttcaaagaagaggtttcaatctgtaaatgtaacatggatgagccctggtgctcctgatttgcggtcagctatgacatctttcttccttaaaatcagtctgcagtccagctctgctccacaacttctct

SEQ ID NO: 2081 - DNA, 193 bp, Nicotiana tabacum
atatcaaatggttagaaaaaaaacactaaaatggaatttctaacccaatgtaaatcataggtcgatgtaactcattattttatttttatattttgaagaaaaaaaaacatcgggggaaagatttttggtggtggcttggtggcatgtaatactcaataattttaatgtgattttggttttgattgtaacaaaa

SEQ ID NO: 2082 - DNA, 350 bp, Nicotiana tabacum
agacaaaaccacaccctcatcagccctcgccggaatctcgttttcacggtgaccggccgttcaaccttctactgaattctttcagctctgaggtcatataattaacctccgatctgaagaagtagttatatatatagctgcttctttttattctgagaacaaaagaacccctgagctgggtaaagtggagttcgtgatgggattttgtatatgtcctttggaaactcctgctagattgctgtggagtactagtttcttccgccacaagctcatgctcttttgaaacttagtcaactctctttttttatacacatccctgctaaaattaaagaaactctgctctagagttt

SEQ ID NO: 2083 - DNA, 354 bp, Nicotiana tabacum
aacactacatacagacaaaaccacacgtagcgtacattaattctcccaccggccctcaccggaatcttgttttcacggtcaccggccgttcaaccttttactgacttcccctttttctttttctctcagctcagaggtcatataattaacctccgatctgaagtagtagttatatatatatatagctgcttctttttattctcagaacgaaagaacccctgagctgggtaaagtggagttcgcgatgggattttgtatctgtcctttggaaactcctgctagattgctgtggagtactagtttcttctgccacaagctcatgctcttttgaaacttagtcaacgatctcttttt

SEQ ID NO: 2084 - DNA, 383 bp, Nicotiana tabacum
aatgcaacacttgcgaaggcacatatgtttaagatttgaacagccttttcccactgcttcaagacttacatcggtcactcctctgcacaaagtgatcgacaaagaagccagagactgaagaccacgagcattacccataacccaaaaccccttctgactgacattacgaagtgaaccgagattaagatcggtaatcaccttgccatagtgaccgatgacagcaagcgagaaatccgtgatgtttagggaattaagtttcactttcttcaacattgtagcacctgacgagagaaggctagcaactccctgatcccctacaagagggcagtctttaatagtaagagactgcaatttggtacagcatcttccaatagcttgcaggc

SEQ ID NO: 2085 - DNA, 265 bp, Nicotiana tabacum
atccgagctctttcctctcagaaacttaccaagttcagcatcaaatggctggccataggattgcacatgccacattgaaaggccctagtgtggtgaaggaaatagttattgcaactgtacttggtttggctgctggtagcttatggaagatgcaccactggaatgagccacgaaaagttaggtcattttatgacttgctggagaaaggtgaaataagtttagtcgcagaagaataacttttcgaggatctcgcgtgagttggctc

SEQ ID NO: 2086 - DNA, 350 bp, Nicotiana tabacum
  modified_base (100)..(100): a, c, g or t
tttccagaatgttgcatttcatgagcgtacacattcaggccttggcctaaatgggcttcacaacattggattgatgataaaattgccacacactggtatntaattgaaaaagagagatacaaagagagaaggagagaaattctatatatggtttgtaagtagcccaatgaactcgaattaaattacatcaacaacaatgggttgttggtcaccggacatacgcctacagttgtttcttgtggccgtcaactgatacggcgaacgatcggtgctaagccactgatcccacgttgaacagctgttgactgcattgcttgtggtctcctgttgaggtgacttccacgtacccc

SEQ ID NO: 2087 - DNA, 339 bp, Nicotiana tabacum
tttgttcttaaatatatatcaatcatttattcatgtggattaaatgacaaatcaaatgaaacacatcctgcataacatgcatacggcccacgccaataaattataacatcagggcttgctattattttggctatatatgttatctatgaatatcttagtagaggcaaacctagcttataattatgcgttcacctaattctaaatagcttttgctcatataagttcacatctgttataaatatttaattaagaaaaatcttgagtccgccctctgtatgctaagcctttggaataaaatcttgaaaaccggacgattgacagccaaacgcctcgatccat

SEQ ID NO: 2088 - DNA, 371 bp, Nicotiana tabacum
tataaaaagccgcatttatttatcgccaaacaatggagtacatggaaacgttaaccatacagctccaatttattatttggaggctacatatatgcctataatcccttagccaacctggggagtttgtacaacaaagtccaatacattaacgaaaagacgaactcgattacatcttaaatcttctgtcacaggagtaccattaagtactgtttgaacattagttagttttggattttccttctgaattatttgcatagcaaactttgctggtgttccaagaagttctggccatctttcctttgtcactcctgggcaaccagactgagacacatcaagttgcaagacattgatttccaaatctcgagcagtga

SEQ ID NO: 2089 - DNA, 348 bp, Nicotiana tabacum
cgggaggtgagtcaatctacggcgccaaattcgccgacgagaacttcaaaagaaagcacaccggtcctggaatcctctccatggctaatgctggacctggaaccaacggttctcaattcttcatctgcaccgctaagactgagtggctcgatggcaagcatgttgtgttcggtcaagttgttgaaggctatgatgtgattaagaaggctgaggctgttggatctggatctggcaggtgctccaagcctgttgtgattgctgactgtggtcaactctgctagatctgaggacgttgatgatgatctagtttatctatatttaagtcgccgtttttggctttgtttttaa

SEQ ID NO: 2090 - DNA, 406 bp, Nicotiana tabacum
ttttatttaaaagccacatttatttatagccaaatataagtggaatacatggagagattaaccatacagctccaatttattttctggaggctacataaatatatcatcccttaaccaatctggggagtttgtacaataaagtccaatacattaacaaaaagacgaacacgattacatcttaaatcttctgtaacaggaccaccattcagtatagtttgaacattagttagttttggattttccttctgaattatttgcatagcaaacttagctggtgtcccaagaagttctggccatctttcctttgtcactcctgggcaaccagactgagacacatcaagttgcaagacattgatttccaaatctcgagcagtgaggggttgaataagtgatgcaagaagcaaga

SEQ ID NO: 2091 - DNA, 378 bp, Nicotiana tabacum
tttaagctaaaacttagttgcattatgccttcattgatcattatcaaaatgctaaaatacaagccaactattgctccacaattgtacataaatggaatttcatgagaaaatttacattgtgcgtaatgcaagctctaaaaaacagccttagcgcattaatgcacattgttgaacccacaaacaatgatcacttttctcgttctttttggacatttggtgcacttggagcttcagccatctgatcatccatcttatctttatttgagctggttgagctattcccattccggcaggcagccaactcctttggttctgagtcggaaaatgctggagagggagagggtgaagtcgtttcttcctcaattggaagtgttagtt

SEQ ID NO: 2092 - DNA, 280 bp, Nicotiana tabacum
agtccaccatcagacacaaagcaacacttgcgaaggcacatatgtttaagatttgaacagccttttcccactgcttcaagacttacatcggtcactcctctgcacaaagtgatcgacaaagaagccagagactgaagaccacgagcattacccataacccaaaaccccttctgactgacattacgaagtgaaccgagattaagatcggtaatcaccttgccatagtgaccgatgacagcaagcgagaaatccgtgatgtttagggaattaagtttcactt

SEQ ID NO: 2093 - DNA, 382 bp, Nicotiana tabacum
tttatatcaatgaacattaagtgcgccggaaaacaaaaaaggaaaatatctgctaacatccaaagaatataggaatacaagaaatctgaaaaaacagaaataaactctgtggacatgcatgatgtgaagatcaagaacagaaccatgataaaagaaaactaccaatcaagatggcatcttatttcctcaaaattgatagatggtgatctgccattaacctccagaggaaccttgaaatcacactcaatctttggcttaattttgggtgttttaatccaaccagccttaagcctaatacgcatgtaaagcttcacttccatctcatatacccctaaatccttctcattactgtaattggatttctctctgtcacccaatagaa

SEQ ID NO: 2094 - DNA, 402 bp, Nicotiana tabacum
ttaatctgcttcaagcgtcaggatcacggagtgctcttggtaggttatggttctcatggctttgctcctatcagactcaaggaaaaggcttactggatcatcaagaattcttggggagaaaactggggagagcatggatattacaagatttgcaggggtcacaatatctgtggagttgatgccatggtctctactgtgactgctgcccatactactaatcctaacctgtgagatgaacttatccgaggaatgttgtctgtgatcaagggttttactacattatcctaatttgtgtaaatatgttatttagtaatgtattgtgaactcaagtcttagatttcatcagcactttattatcgtgcttcaaaccacgtagtgggatttgtatttctgtagtttata

SEQ ID NO: 2095 - DNA, 473 bp, Nicotiana tabacum
ccaggatgatcctgtgattcagtgcattaaagaacaaggattagatcttagctttggaggaacaaaggaaaataataattaccccttgatgcagatgtgtgttgatacttattttgcgcagagaaaaccgcttcaggcattaaccctgttacataattatgcctggataatgtccagtgaaacgactgcatttcaggaacgctatgattttaatatcgatgaatggcgggcaaaattcaggcagttatgtttagagtattttggcgatagtcgtacacagttcacttaacgctctgcgtctatctactatcccttctttttcagaaaaaccgccgagcatgtcggcggctttctgacttacaaagtaacagattacatcagcggcattgccaaacgcacaatgctaatcagcggttgtggccatacacccagcaccagtaccaacagtgcagagatcagcacaacgataccgc

SEQ ID NO: 2096 - DNA, 571 bp, Nicotiana tabacum
attcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagctt

SEQ ID NO: 2097 - DNA, 172 bp, Nicotiana tabacum
tcgctttcgcccactgtttacgcatgacattacgcaaacagccacaggcggaagtgctggctcattatctcaagactgaagatcttcagcgtgtactggcttcgaactctccagctaaccgtatcttgttaataatgggagaatggttggcggttcagcgccgcaatggaca

SEQ ID NO: 2098 - DNA, 255 bp, Nicotiana tabacum
taaaaataatacatttggtgtcaaattatttcaccaaggcaaagtattagttccacatgttttcaatagcttacttatctttcactggaacactcatttctgtgaaatgagtttacatataatttgatgatgttaagctatttattccctgtaatggtaaactgatactccatatttctgataactggcctaagatgcctccattgtacattatttctttcatatatcatcatatagcagaacttcttttgaaaa

SEQ ID NO: 2099 - DNA, 250 bp, Nicotiana tabacum
cattcgtgactatacttctcatattaatccttacatctgatcttaatgactttggatttggaaatcatctatttgtcgaaaatccaaaattcgaagacccacccatctttgatgaaatcaaggatggttcgaggtttctgtacatataattcaagaagatgtggggagagtacctatgtacatagttggggttctctccttatttgttcttattagctgtgatgatgtgatatgcatctcgttcataaat

SEQ ID NO: 2100 - DNA, 269 bp, Nicotiana tabacum
ttttaattgtaaacggtaaatcttcattcacttcattccagagaactttgtaaatacagatccacaacgtaacatcacggtaacaatctcacggtcaaaaacgaggacggtagcaggaaccacagtaaaccataacggaacttcaaccaaacttagaaccataaatttcaaaccaaaaaaataaatctaaaggcaacggaaaatctaactcctccagtttccttcagagccaccaccgtaaccaccttcacgacggccacctccataac

SEQ ID NO: 2101 - DNA, 250 bp, Nicotiana tabacum
ttttacaccaaagagatatattataacgccattgtgtaccaaacataattacataatgtcttttattcatacataacacaacaagttttaaagtagaaagagaattactattacaactttaccattacaaaggttttatatcttacacgatgatcagtgttgaggcttcccttcagtcactttatccatggcctcacctttgtagtagcaacacctgctgcagccgtagtaattgcggcgaccgcaacaa

SEQ ID NO: 2102 - DNA, 356 bp, Nicotiana tabacum
accgtctccacttttggtcccaagatgaatgcagggaagatacggatataaacggctacactattccaatcactagtgaattcgcggccgcctgcaggtcgaccatatgggatgagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcat

SEQ ID NO: 2103 - DNA, 299 bp, Nicotiana tabacum
catggatattacaagatttgcaggggtcacaatatctgtggagttgatgccatggtctctactgtgactgctgcccatactactaatcctaacctgtgagatgaacttatcccaggaatgttgtctgtgatcaagggttttactacattatcctaatttgtgtaaatatgtcgttcagtaaatgtactgtgaactcaagtcttagattccatcagcactttattatcgtgcctcaaaccacgtattgggatttgtatttctgtagtttatactgcaaaaatgaagttcgaattttaaaa

SEQ ID NO: 2104 - DNA, 263 bp, Nicotiana tabacum
gaacactcaagtctaagctttaattggacttaggaatgaaacgagtagcagaagattgtccttgctgcgtgaatatccaaattatgtactaccttatgctagctgctactataattgtttgtcatatagaggtgctgaaaccaataaatatgttcttgtaatcaaccaaagaaatgttaaagcattagatgctgtttgaatgtaacaatagacgtacttgggaaaattgtgggaaataataatagaacatttgttaattaaaa

SEQ ID NO: 2105 - DNA, 317 bp, Nicotiana tabacum
atattatggtggtggttataaacgtagaggatgccgctatggttgctgcaggaaaggttacaaaggatgcaaaaggtgttgttcctacgcaggtgaggccatggataaagtcactgaagctcagcctcacaactgatcattatgtgtaatatataaagagtgtaagttatatatgccgttagcgtatataacttatacattgtgctactttagaccttgcttgtaacaagtatgaataaagccattcggttcttagggatggttggtcatgtaatgttttgttgtacaatatattgtgataatatgtttccataaaa

SEQ ID NO: 2106 - DNA, 162 bp, Nicotiana tabacum
tttgcatataatagaggtttgaattatacgttcgaattacaccacttattcatcatacaaaagtgcgggtagataagaaaaacagtaataatacattctaaaatccctttaattattcaagaccagaaccacccaataggctctccttcttcatgttgctgc

SEQ ID NO: 2107 - DNA, 442 bp, Nicotiana tabacum
ttttggtcaaaattagattaattattgtgtctaataataaacaaaaggaaccttattatacatgatacacaatactggaatataatgtattgtcttattgtatgaactaaaaaccttgcaaccatacaaaaaatctcacctatatagcccttcttctttaattcttccaagaactccattaaattaagctattcttgctccctgtgatttgtgggaatcaagtagaggtcatctttgcttgctgcaaaaactctacttgtttcagtagtgcgaaaatcatttgcattaaccttgtcagggagtttccagtcaaagcaatagagcaactgggctaaaggatgccctgtgttaactaaaccaaacgacattcctggacacattcttcttcctgaaccgaaaggaatgaactgatagtgatttcctgtaagatcaacagaagtat

SEQ ID NO: 2108 - DNA, 512 bp, Nicotiana tabacum
gaaaatgataacatcaaagcagttattcttgttctcgttgtgctactggtggttacggtcatgcagtctcttaaagaggagccctcaagagaccacgtagatcatccaagtagttctgcatctccatcagaagcacttcgctctggagacaaagaagacaagatagactaaaattttcactttggtgaacgtcaatcccaatctgaccgagataagttgcttgagaaatctttgaaaagatgagcaatcgacatggcagtcactgagtggttcaaccatgttggtaaccataatcatcgtaagccagtatacgagcaactatagttgtaagattgcttctagcgttttctgcatccagtgataggaaatgaatactcagtgcaaggatttgttgacagtaacggttctgaaaatggagacaaattttgtttcgttctgtgtaaatgagttcaagacgaaaaacaaaaatgctgcgagttctatttcgcagcttgtccactgttataataaaa

SEQ ID NO: 2109 - DNA, 360 bp, Nicotiana tabacum
ttttagacaaggaacttttatttctggatagaaatttcgttttcatcaatgcagtagcctcatcacttaaaagcgcctcatatataggagctattggttcttcccaagaagacaaataacagaaatatttcacctaattcttaatggatacacaatccccttattcattaattaatacaaatataacttgtatacataacatgatctgcattctatgtaacgaagcctagccctggccgaagttcctttggttgtaacagtccaagttttcccccggagcaacatttaacataccacaatacctcctgtagtatccaattcgatcttccactgcgtcattccgtcctatgccacattcaa

SEQ ID NO: 2110 - DNA, 158 bp, Nicotiana tabacum
attatgtcattagtaagttattagtgctttgtaatgcaacttaggatttcggttagttaacagatgcttgcttgatgatgcttttaatcctactttggatgctttattctactgtggatttttttgctatatgctattttacatgttttaagccaaaa

SEQ ID NO: 2111 - DNA, 410 bp, Nicotiana tabacum
gttggtttgaagaagcgatcccttgacgttaatagcataaatgctgcaagagtagccagactacaagacagatatgggaagaatgtgaatggcatagaaaagaaattgggtgactcagatttggatatagtctccttaaagaactacttggatgcgcagtactatggagagattggtgttggttcacctcctcagaaattcgaagttatctttgatacagggagctctaacctctgggttccatcatcaagatgctacttctctattgcttgctggttccactccaagtacaaggcgagcaagtccactacatatacaagaaatggggaatcttgtccaatccgctatggaactggatctatctctggccatttcagtcaagacaatgttcaagttggtgatctggtagt

SEQ ID NO: 2112 - DNA, 282 bp, Nicotiana tabacum
gtatggatttcgcctttgtagattgtttcagctcaaccagctggctctcaacgagcctcaaaaaattcgactctaccactactatattccagtcttcttgtggtgtgaacaggaaatttcacagcatagttccaagttcaaagacaacgaagaaatccctccgttggtgattggcttcagtgcgcctcaaggatgtggaaagacaacactcgtatttgcattagaatatctttttaaaatcacagggaggaaagctgctacactatccattgatgattttta

SEQ ID NO: 2113 - DNA, 217 bp, Nicotiana tabacum
cactgatagacataacttggatcatgaatcttgatgataatccatgattttacatacttataccatgcatcataataagcttctaagttcttgttgactgtctcaagctgtggatcaacagctttgacagcttcaggtggaagaggtttgaaaccaagcatccaaccctcaaacagaattaccgttaaaggcccttcaacctctggccatgtggagg

SEQ ID NO: 2114 - DNA, 395 bp, Nicotiana tabacum
gaccgtattcctccattgcggtcatgcagagtaccattccaactccgcacaagttgtgcttcctgctcaagacccacatcagaaggcttgattttgtccagtagggaacggactttctcgagagcatcttctgaaaccggtccattaggcgaaagtgatgctttacaagcgttataaagcttttgtacagctggcatgttccgcaaatcgagaatcgttatacccaccgcctatacaacaaaacttatcttactgtggctaaaagcttcgaactaacccaaaaattttccagcctgaagggtcctctatttcccgaagacccctcaagaacagcctttcaagcagaagacccttcaatagcacaattgggcacaaactggactgtacgatgcaaa

SEQ ID NO: 2115 - DNA, 461 bp, Nicotiana tabacum
atcctgtcctctcctgctcctcttcagacaatccttactataactcttttgttttgtttaaacctggtggcattgataatagagtatagaactgtatcagttaagctacacatggatatgtaatcatcggtttggtttgcatcgtacagtccagtttgtgcccaattgtgctattgaagggtcttctgcttgaaaggctgttcttgaggggtcttcgggaaatagaggacccttcaggctggaaaatttttgggttagttcgaagcttttagccacagtaagataagttttgttgtataggcggtgggtataacgattctcgatttgcggaacatgccagctgtacaaaagctttataacgcttgtaaagcatcactttcgcctaatggaccggtttcagaagatgctctcgagaaggtccgttccctactggacaaaatcaagccttctgatgtgggtct

SEQ ID NO: 2116 - DNA, 319 bp, Nicotiana tabacum
gaccgatagaaccggtatagaacgtcgaggtcaggttggtctggttggtgagaattttattactcacatctttggtattcgccgtgcgtgaccaggtccagctattcacatcgctggtgggctgagtaatattcgacgccccgcccataatcgccgtcatcaggtaatcctgctttacgcgcgaccaacgggtagtattgcgaatggtggtgttatcgttgatgtcgtgctcaaaacgcatggtggcggtgtcggtggtcgaatcgtcgtaatcggaatccgtgccgtaaaagttatgagtatcaacttttccggaatg

SEQ ID NO: 2117 - DNA, 284 bp, Nicotiana tabacum
tgcagggtgaagccagcactcaaaaatcccatgcgcatactcacaagcatctcctcgctggcatgcccccttgcgaaaatctggacaagggacacaactatagtggtattttctagggtcacgccttctggcgttttcaccagggtgtacaaagggacactctgtccagtcatgggagtaagctcttgagcatggtttcaccttaaatatgtacattctgaagtcatctgtcccatatatcccaatctttatgtccggaagagagggatcaacaggatactctt

SEQ ID NO: 2118 - DNA, 282 bp, Nicotiana tabacum
gcttcattgagaggtccatggcacgcttaaggcgctggattctggcatcaacaatctcccttggaaggcgattaagagcttccttgacgtccaaatcgtacattggatcatgcagatcatcatatctaagcccgtaattacggaggcgatgcggagagggatttcttgtggattgcagcgagagggttcttctttggatccaccagccatttcgagaacgtcggtgccattgttcgatcgtaaaacacacacccacacgcactgtgtctctgctaacaaaag

SEQ ID NO: 2119 - DNA, 332 bp, Nicotiana tabacum
gcaaatgcggaacaaaaccggattctcagattgaccggagaagcaaggaaggaaactaacagcacatcatcagccatgggttccgatcctgaaaagttgatgaccaaagccgataaactgacaaaattaagttttaccaggtggagtagcgattggagaagtgctactgttttatatgagcaggcagctaatggatttagggttgctaaaagttatgagaaagcaaaagaagcatttgagaaagcttcaaaaggacaagagatgctttcctcgccttgggatgctgctaaacatatggagtctgctgctaccatggcgaaggaactaggcaa

SEQ ID NO: 2120 - DNA, 196 bp, Nicotiana tabacum
ctacaatggttggtattttataacatgcaattatgatccaccaggtaattggagaggacaacgtccctacggtgatcttgcagagcaacagccctttgattccaagttggagcttccaactgatgtataataataataatggtgtacatgatcaaataatgaataaaagctttatcctgtgttaaggaaaattaaa

SEQ ID NO: 2121 - DNA, 342 bp, Nicotiana tabacum
tatgccatgggctccacgatagtagctgctagtgatagtcctaaaacgctcttgtccagcagtatcccaaatctgaagcttaatggtcttcccatcttgctccactgtccggattttaaaatcaactccaattgtgcttatgtagctctcctgatatgtgtcatcagcaaatcttaaaaggagacatgacttcccaacaccagaatcaccgataagcagaagcttgaacaggtagtcatattctggattcatggagactaaaagcagacggaagtcgccggaatattgagagatctaccggcgagaattggacggaatttgattcttcgcggcagaattcag

SEQ ID NO: 2122 - DNA, 232 bp, Nicotiana tabacum
ccaaaactaactaatgttcaaacagtacttaatggtactcctgtgacagaagatttaagatgtaatcgagttcgtcttttcgttaatgtgttggactttgttgtacaaactccccaggttggctaagggattataggcatatatgtagcctccaaataataaattggagctgtatggttaacgtttccatgtactccattgtttggcgataaataaatgcggctttttaaaa

SEQ ID NO: 2123 - DNA, 344 bp, Nicotiana tabacum
agctcttagacctattagagaagatgaagttactgctatggttgaaaacattttcaaggattgtactaagcctgataacacaggtaaaagcttgttgataagatgagtacttaggatcagtagcattcaacaacattacaaggttaacatttgggaaaaggttcatgaactcaaaaggtgagattgatgagcaaggtcaagaattcaagggtattgtctctaatggcatcaaaattggcggaaaacttcccttggcagagtatgttccatggctccgttggtttttcacaatggaaaacgaggcactcgtgaagcactctgcacgtagagaccggttaacaaga

SEQ ID NO: 2124 - DNA, 474 bp, Nicotiana tabacum
tcattcaatacaatacgagtaatgtaatcattattattacagattattattcttctcaagtattccaatcacattttgattattgaaaatcatagatctaaaatcttgacttgacttgacttgacacagtctaatatagaaatgcaactttgcaggacaatccaattccaaacgttgatcaagtaacctgatctaggccttgacgtcttgaacaattgttgtaattgcaaatcctgtttggttagcacgatggacagtccctgctagtttattgtctgaaacattcagtagctgcaaatttccccagtagatgagcttcaagactgagattggaattttccctgataatttattaccgttcaatctcatccatcgcaaagatattaaattgccaagagatgatgggatagggccactcagcttgttattgtctaatcccaaactcactagccttgtcaagttgcctaattggct

SEQ ID NO: 2125 - DNA, 545 bp, Nicotiana tabacum
tactgagtagatgtcaaccttctctcaataggagttttccgcttactcaccacaaacctgttaacccccttgcgcattggcattatcgatgggaagtcttcatctggtatctgactcaattcagaaatgtcttttatctgagcaacacggcggaaccacctctcagctttggcttcttcagacatgtccaagggatctgggtccttcacagcagacccttccaagctgtttcctgtccatccacttctgatattctggtttccaggcagctggggtgaacccactcccacagtctcagaaggggatacatcatctatcaccgagtttctactgccactactatcagtgcttgaagcatcggaagcaagagaagtctcacctatgtttctaatacgagggaacccctgatctccagagaaatttgaacttacaaaccttgagcttgtaaatcgatcatcagttctttgtacagtgttcatatctgtgaacttatatccagaatcatctgacttttgatgtgtcttctctacatctgccgtctcaga

SEQ ID NO: 2126 - DNA, 291 bp, Nicotiana tabacum
ttcattgagaggtccatggcacgcttaaggcgctggattctggcatcaacaatctcccttggaaggcgattaagagcttccttgacgtccaaatcgtacattggatcatgcagatcatcatatctaagcccgtaattacggaggcgagcggagagggatttcttgtggattgcagcgagagggttcttctttggatccaccagccatttcgagaacgtcgatgccattgttcgatcgtaaaacacacacccacacgcactgtgtctctgctaacaaaagattagggatttc

SEQ ID NO: 2127 - DNA, 517 bp, Nicotiana tabacum
taagcacatcctttagagtaaactactacttgttccaaaggattgaggaaaccgcggttcttagctgataatgtagagcaaacgaaatccagcacacaaatgtctgtacatacccctacaaccaacaaagtttgaattttgttgtttttcacccaatcaacaaatacattagagccatcctcctgaaaagaaccaatatagccatcgtagcaatctttacgcctgattgttacgttttgttccttctccaaccatcttagtgcaggaaccaaattggattcatcagtgccagtgatacagtgaggaggataagggtgttcaagtttgtgaggttggtgtgaatcaagaaaggcaagaataggtcatttcttgtcacagaacaatctagccagcctttttgattcctcaatcatttcagagatctgcctgtttggctctcttggtgccagatttccagctccaacagtgcaaaagccattgatgatatccacaagaacaagaccagctttcacatctt

SEQ ID NO: 2128 - DNA, 419 bp, Nicotiana tabacum
aattacaccacttgggctatgactaggattctcatatttgcgtttgtgtgaaatgggcttagaacacacttctgatatgagttcaaagcaattattcactttctccttgttaattttgagaaccccaagaagttgattttggtagtcaacagaattacaaggctcaacttgatgaataacgtgaagcataattgcagtggccaatacagacggcatataacgtacgaatctacaatcagccataatagagaggaggagattttcacatcttctaagaaattcccagtgaatattatttcttagcccaagcctccttataatatgatcaagaaatgaaagtggggtcactggattcatcctccattttagtgaagacaacactaaaagctccattctttgaatagtttttgcctcaaacc

SEQ ID NO: 2129 - DNA, 314 bp, Nicotiana tabacum
taaatgtgtaaacacagaaaagaaaaactcgagaacagagttcttttagcagggatatgtatagaaaaagagatcgttgactaagtttcaaaagagcatgagcttgcggcggaagaaactagtactccacagcaatctagcaggagtttccaaaggacagatacaaaatcccatcgcgaactccactttacccagctcaggggttctttcgttctgagaataaaaagaagcagctatatatatatataactactacttcagatcggaggttaattatatgacctctgagctgaaagaaaaagaaaaaggggaag

SEQ ID NO: 2130 - DNA, 535 bp, Nicotiana tabacum
aattacaccacttattcatcatacaagcgcagataattaagaaataccgtaaataatacattctaaaatccctttaattatttaagaccagaaccatccaataggctctccatcttcatgctgttgctcctctgccgccacaaagacattagagaagtagccatggccgccgccatcatcactaccatcatcctcctctgatggcaaaccatccataggtggaggaatattattgcatcctccagcccctattggatactcttcaatatgaccagtgtgaaaataggagtccccactgtccaccagctgtggactgtgctcatctaccaccgcgcttccgccgctgccactgctcagcctgtcctccgccttcaccttcacttgaagggtcatagcatcaacctccaaaacctcacatttttcacctactacccctgcttcaccaaccactttcccctgcagcttctccatcaatgaaaccacctcagctttgagcttctcattatctttgcgcatggagtcaaaatcagagaga

SEQ ID NO: 2131 - DNA, 510 bp, Nicotiana tabacum
tcttaatgaattacaccacttattcatcatacaaaagcgcgggtagataagaaaaacagtaataatacattctaaaatccctttaattattcaagaccagaaccacccaataggctctccttcttcatgttgctgctcctctgccgccacaaagacgttacagaagtagccatggccgccgccgtcatcactaccatcatcttcctccgactgcaaaccatccataggcggaggaatattattacatcctccagcccctagtggatactcttccatatgaccagtgtgaaaataggagtccccactgtccaccagctgtggactgtgctcatctaccaccgcacttccgccgctgccactgctcagcctgtcctccgccttcaccttcacttgaagggtcagcgcatctacctccaaaacctcacatttttcatttattacccctgcttcaccaaccactttcccctgcaacttctccatcaatgaaaccacctcagctttgagcttctc

SEQ ID NO: 2132 - DNA, 557 bp, Nicotiana tabacum
cttaatgaattacaccacttattcatcatacaaaagcgcgggtagataagaaaaacagtaataatacattctaaaatccctttaattattcaagaccagaaccacccaataggctctccttcttcatgttgctgctcctctgccgccacaaagacgttacagaagtagccatggccgccgccgtcatcactaccatcatcttcctccgactgcaaaccatccataggcggaggaatattattacatcctccagcccctagtggatactcttccatatgaccagtgtgaaaataggagtccccactgtccaccagctgtggactgtgctcatctaccaccgcacttccgccgctgccactgctcagcctgtcctccgccttcaccttcacttgaagggtcagcgcatctacctccaaaacctcacatttttcatttattacccctgcttcaccaaccactttcccctgcaacttctccatcaatgaaaccacctcagctctgagcttctcattatctttgcgattggagtcaaaatcagagagaagagagtcataaga

SEQ ID NO: 2133 - DNA, 248 bp, Nicotiana tabacum
ttttaaaaattcgaacttcatttttgcagtatgaactacagaaatacaaatcccactacgtggtttgaagcacgataataaagtgctgatgaaatctaagacttgagttcacaatacattactaaataacatatttacacaaattaggataatgtagtaaaacccttgatcacagacaacattcctcggataagttcatctcacaggttaggattagtagtatgggcagcagtcacagtagagaccat

SEQ ID NO: 2134 - DNA, 595 bp, Nicotiana tabacum
taatgaattacaccacttattcatcatacaagcgcagataattaagaaataccgtaaataatacattctaaaatccctttaattatttaagaccagaaccatccaataggctctccatcttcatgctgttgctcctctgccgccacaaagacattagagaagtagccatggccgccgccatcatcactaccatcatcctcctctgatggcaaaccatccataggtggaggaatattattgcatcctccagcccctattggatactcttcaatatgaccagtgtgaaaataggagtccccactgtccaccagctgtggactgtgctcatctaccaccgcgcttccgccgctgccactgctcagcctgtcctccgccttcaccttcacttgaagggtcatagcatcaacctccaaaacctcacatttttcacctactacccctgcttcaccaaccactttcccctgcagcttctccatcaatgaaaccacctcagctttgagcttctcattatctttgcgcatggagtcaaaatcagagagaagagagtcataagaggatttgagctgatcataatccctttcaagggtctgggtct

SEQ ID NO: 2135 - DNA, 474 bp, Nicotiana tabacum
gaattacaccacttattcatcatacaaaagcgcgggtagataagaaaaacagtaataatacattctaaaatccctttaattattcaagaccagaaccacccaataggctctccttcttcatgttgctgctcctctgccgccacaaagacgttacagaagtagccatggccgccgccgtcatcactaccatcatcttcctccgactgcaaaccatccataggcggaggaatattattacatcctccagcccctagtggatactcttccatatgaccagtgtgaaaataggagtccccactgtccaccagctgtggactgtgctcatctaccaccgcacttccgccgctgccactgctcagcctgtcctccgccttcaccttcacttgaagggtcagcgcatctacctccaaaacctcacatttttcatttattacccctgcttcaccaaccactttcccctgcaacttctccatc

SEQ ID NO: 2136 - DNA, 453 bp, Nicotiana tabacum
agctgcttctttttattctcagaacgaaagaacccctgagctgggtaaagtggagttcgcgatgggattttgtatctgtcctttggaaactcctgctagattgctgtggagtactagtttctcccgccacaagctcatgctcttttgaaacttagtcaacgatctctttttctatacatatccctgctaaaagaactctgttctcgagtttttcttttctgtgtttacacatttataaacttctgtgtgtgtaaatatattttctacggcgatcgtccaaatcatagaaaatatgggatctgggcatatatttttcgacccgtcttgtcacggcaacatgttgttccttgggaattcagatcctgttttccgaggaccaagatcgatgatgaagatggaggactcctcaaagaggcgacctttctttagctcgccggaggaactatatgacga

SEQ ID NO: 2137 - DNA, 201 bp, Nicotiana tabacum
gggctggttcattagttggagctttttcctggctgcgagtaggttgagaattgttaccaggctctccacttccaaacaggtatcccaaagaactctggccacctccagcacttactccgcgacccatctttaatcgactgatttctcaacaaaaaaccccaagtactttgttatcaatgccgaatcagttacagaagcgag

SEQ ID NO: 2138 - DNA, 211 bp, Nicotiana tabacum
gggctggttcattacttgcagctttttcctggctgcgagtaggttgagaattgttaccaggctctccacttccaaacaagtatcccaaagaactctggccacccccagcacttactccgcggcccatccttgattgattgatttctcaacaaaaagccccaagtacttaggtatcaatgccgaatcagttacagaagcgagagacggagag

SEQ ID NO: 2139 - DNA, 454 bp, Nicotiana tabacum
cttaaaaagagtttataatgcttaagcctgcagcagattccagaggcaatatcaactgctgtcattcaatgttagttggttgggcaaccagctggctcgcatagttaaggagattgctaacagcattttgggaggtggccttttcatcacctttggatcagaaaactctctttatctctttcctttatttgtcatttgttcaatgagttggttgtgatttgcaattcttgggcaaggagaggcagccagtaatgttagtgctaactgttttcccgttatttcttcgttgtttctttaagtaggtgatggcaggcaatacagaagccatccgacatctggaaatttggatctttccgggctgatgttttatgtactctagtttttcatagtttcaggcagtaccaatggctgcttttgtattcctatagaactgcaaaatgggaatgaatcgaat

SEQ ID NO: 2140 - DNA, 448 bp, Nicotiana tabacum
gagcttttggtaagccacagggtgtttgtgctcgtgttgcaattggtcaggttcttttatctgttcgttgcaaagatggaaacagtagccatgcacaagaaatctcccctttgcttagaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtatt

SEQ ID NO: 2141 - DNA, 505 bp, Nicotiana tabacum
gtagctccggccgacggccaaagagtttatcaccgtcttctcctctaatttcaagctgctatgtctcaggttgataacagaaattcttctgctgccaaacgtgcccgaactgacggtggccgtagggaagatgactggacatgtccaagctgtgggaatgtcaatttctccttcagaaccacatgcaatatgcgcaactgtactcagtctaggcctgcagatcacaactcaaaatctgcagttaggccaatgcaagctccacatagctattcaccctctgctgcatatgttgggcctggtgcaccctcttcaatgtatatgggggtagcaccttatggtggttctttgttcaatggaccatccatgccagcctatgacgttcctttttctgggggctcagcttatcattacaatattgggagccgtctttctggtggcagcccataccgcccactgcatttctctgctccacctccttacactggtgggtctgtgattggaaatg

SEQ ID NO: 2142 - DNA, 408 bp, Nicotiana tabacum
caagacagaattaagtgatgatcttcaaggaagtctggaagcattggcgtggggaaaaaccccttccacagggactggtttttcattcgacattatctattctggaaagggatatgagcctgctgcaccaacagatgtgtatgctctgctgggcaaccatgtcacatcaaataagcaacaggtgaaggtcactcttgacgaagacaatgaaacggctgacaaggctcttgcacgacgtctttgtaaacttgatgatctcaatacaaagagatgtaaaagccagtggtcaattgcaaatttgagaagtttcctttcattcaacggcataaagaagctctctcaggcattgaagcaaatgctgtccaaatatgctattgatcgcgagttaagtgaagcagacaagtccat

SEQ ID NO: 2143 - DNA, 219 bp, Nicotiana tabacum
ttttactcgagaaaaagttgtgcttttaagctttgacaaggtaacatacattgaacctgcatattaagaaagaaacttaaaaggaaagtaaaacattgtaaaaaataaagaagtctcaaagtttgcagttcacacacacacacaaaatgcccggtacactaagctccgttatacgcgaggtccgaggaagggtcggaccacaagagtcaattgtacgca

SEQ ID NO: 2144 - DNA, 364 bp, Nicotiana tabacum
ttttaatccaaatgcattattgatctatataacatcaagacaaaaatacatatgtgactcttattcaggtcttaggtttattacagcaaagatcatgacttgatcacttcaaacaaagtacgtaactataaaaacgagtcaaatagattgtcttacactaacgtgtcgatagaataatttgaccaaaaggtgatcttattacagaaatagccactctacttagccacttcatcacttccaggcatttccaagggaaaatttgggtgagcttgaccattaggacaaaagataaccctataatttgtactaccaccagggcaagtaaaagtgctagtaggatcatcttgtgggtagctataggcat

SEQ ID NO: 2145 - DNA, 409 bp, Nicotiana tabacum
ttttccctacattttcacgcttatataatgaaatatttcatgaatgcacaacatctgcatgctactgtatgttttcagttacctgtatatgactagcaggattgagctgagaaattttgagaacaaaaaagaaaaaggaagagaaagaaaagatcgacgataactaactaatcttaaaagaacagtgactgactaatttttcaaccaacaaatatctactatgactcaacgatagctgcggtaagcggggctgtacatacagctctctgcatatgctactaggttcgcaggttccggtagacgagtggccaaacctagtttatatgctttagctgccactttggcagctatgttggctgaaatctttcttatgttggtaaatggcgggtatatgagccccttctcaaag

SEQ ID NO: 2146 - DNA, 116 bp, Nicotiana tabacum
tattgagggtgatggttttgccagtgagggtctttacaaagatttgcatcttgaaaaggttgttgggaatcaaacgagcgagaaaagagagcttcttagagaaggaaaagcagaac

SEQ ID NO: 2147 - DNA, 307 bp, Nicotiana tabacum
caagaatgaaagtgatgaatctgacttggattataaggagagtttctacatcggctttggcgtgtcttatggagcaatcttgctgggattagctgcagcactctacttcaatccttattggagaagggcatggtttacgcttgttgaggcattaatggtcacttcttactattttctcttagacaatgttgttagtcctttcaagaattggtggtgaaggaaggtaattgttattctcttattgttgctactttatcatttgctatgttgctactttatcaccctcaatattgggtctcgtaccgcc

SEQ ID NO: 2148 - DNA, 419 bp, Nicotiana tabacum
caccgatgcatattgacgaacgaaacgccggtaatacccagcaagtcccaagaaactacgcacttctttgatagacctgggaactggccaattcttgatcaccctcaatattgggtctcgtaccgccaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaat

SEQ ID NO: 2149 - DNA, 329 bp, Nicotiana tabacum
tggtttcgtactttacctttctgttctctgcttttcttgtgtgccaatggaaagtagtaagaagcaagtgggttcatcattttctgcagatatttttgattccaccatagaatctactcagccatccaattccaccgggattttctcttcactttttccaccaccatctaaggttatgggaaggaaagcttcagcatctgaacttttgcaatctctggagaagcagtcgtctggttgtagggaatggaacaaaccacctccagctgatgtgacgaaagatagagaaggtgcagggcattgcacatccagtaaggaacgcgaatcacttt

SEQ ID NO: 2150 - DNA, 395 bp, Nicotiana tabacum
ttttacccaacaatcaactccttacccactcaatactcaatatcttcaatccaacatgagaacaaaaatacagaaaataaagctggaatataacaatgcaactgcatttctgatccagtaggaagtaagtattttcctttcatcaacattgtcactctaggaaaatcagaaacactttctgtggacaatagaaggaccagattcgtcatactctgcctttgcaatccacatctgctggaaggtgctgagggaagccaagatagagcctccaatccagacactgtatttgcctctctggtggggccaccaccttaatcttcatgctgctaggagccagtgcagtaatttctttgctcattctatcagcgataccccggaaccgtagggagaggaat

SEQ ID NO: 2151 - DNA, 247 bp, Nicotiana tabacum
gtcgtccggacttgcgttaccctagagccgcccctgtcacagagtaatcgtcgtccggtagaagatgaggccgatattgatgaagggccacgaaaggccattgacgtttctgaaatacaacagagacggggatctgctcttctcttgcgctaaggaccatacccctaccgtttggttcgccgataacggcgagcgtctcggcacttaccgtggtcataacggcgctgtttggtgttgcgacgtttcc

SEQ ID NO: 2152 - DNA, 316 bp, Nicotiana tabacum
ctgagtttcgttttaaatatggatatgaaatgccagtggatgtactgtctaaatggattgcagacaagtctcaggtttacacacagcatgcctatatgagaccccttggagtagttgctatgattttgggcattgatgaggagaaaggaccccagctcttcaagtgtgaccctgctggtcatttttttggtcataaggctacaagtgctggatctaaagaacaagaggcaattaattttttggagaagaaaatgaaaaatgaccctgctttctcctatgaggaaactgttcagactgcaatttctgctcttcaatt

SEQ ID NO: 2153 - DNA, 395 bp, Nicotiana tabacum
gtcgtccggacttgcgttaccctagagccgcccctgtcacagagtaatcgtcgtccggtagaagatgaggccgatattgatgaagggccacgaaaggccattgacgtttctgaaatacaacagagacggggatctgctcttctcttgcgctaaggaccatacccctaccgtttggttcgccgataacggcgagcgtctcggcacttaccgtggtcataacggcgctgtttggtgttgcgacgtttccagggattcggccaggctaataacaggaagcgcggatcagagtgcaaagctgtgggatgtccaaactggtacccaactgttcacattcaactttgattcccctgctaggtctgttgatttttcggttggtgataagctcgcagtgatca

SEQ ID NO: 2154 - DNA, 411 bp, Nicotiana tabacum
ttttagagaagtttatgtaatatttaaagacgtgttacagaaacctcataagatacgtaattctccctagaaaaaggagtgcaagttttccataaataccaaaacacttgacacaaaataacagtcagctttcctcccactatacaaatcaagcatcagctctttactccatccaccaaaaaatattgcaaaactacaacattgcaatctatattgagatagtatttgctatctcaatttgccaaaagattacaacatcaagaactgcagatgctttgattccacataattcagaaccctcttcctcttaagagatttctaaccaaaaacacctactcactataatacaaaacgtcatacttctattttgtgcctcgaatcatgctactctacatatgtctgtcgacactt

SEQ ID NO: 2155 - DNA, 420 bp, Nicotiana tabacum
aacaatgcaagagcaaagacgaaaacatgccacacatgaggaataccgattctctcattaacatattcaggccagttatctgggcttaaaagcagaagtccaacccagataacgatcatatacatggttctctccagaggttcattactgaacactcgtccgagaataacgagtggatccatttctatactcatcaaactgtaggggttgtaatagtttatccgatttctcgctgtaggggtacacgagaaccaccgagcctgatgtggttaaaagacaggcacaatctttactaccgcaatccactatttaaggtgatatatggaagaagaatttgaagagttcgaagagcatcctcaggatgtgatggaacaataccaggactatccgtatgactacgactattgataaaaatcaatt

SEQ ID NO: 2156 - DNA, 357 bp, Nicotiana tabacum
caatgttgaagaaagtgaaacttaattccctaaacatcacggatttctcgcttgctgtcatcggtcactatggcaaggtgattaccgatcttaatctcggttcacttcgtaatgtcagtcagaaggggttttgggttatgggtaatgctcgtggtcttcagtctctggcttctttgtcgatcactttgtgcagaggagtgaccgatgtaagtcttgaagcagtgggaaaaggctgttcaaatcttaaacatatgtgccttcgcaagtgttgcattgttccctgttgatggacttccccaatcactagtgaattcgcggccgcctgcaggtcgaccatatgggagagctcccaacgcc

SEQ ID NO: 2157 - DNA, 432 bp, Nicotiana tabacum
aacaatgcaagagcaaagacgaaaacatgccacacatgaggaataccgattctctcattaacatattcaggccagttatctgggcttaaaagcagaagtccaagcccagataacgatcatatacatggttctctccagaggttcattactgaacactcgtccgagaataacgagtggatccatttctatactcatcaaactgtaggggttgtaatagtttatccgatttctcgctgtaggggtacacgagaaccaccgagcctgatgtggttaaaagacaggcacaatctttactaccgcaatccactatttaaggtgatatatggaagaagaatttgaagagttcgaagagcatcctcgggatgtgatggaacaataccaggactatccgtatgactacgactattgataaaaatccatggtgtggacaat

SEQ ID NO: 2158 - DNA, 465 bp, Nicotiana tabacum
ggcttctgctgcatctggttttatggtggccacacccaatattgctacctctaacactgctcctcgcacctctatgttattcttctcctcctccaagaacaacaccaccaccaacttcccgaggctcgttgttagggccgcggaagaggctgcgccgccagctgctaccgccaccgctgaaggtgaagctcctcctgccaaagctgccaagccacctccgattggacccaagagaggaaccaaagtgagagttttaaggaaggagtcttactggtacaagggtgttggttcagttgtagctgttgatcaggatccaaacacacgctacccagtcgtagtaaggttcaacaaagtgaactatgctaatgtatctaccaacaactacgcattggatgaagtcgaagaagtgaaatgaaagaatggaagtaattaactagttcatggtttttcatacttgtaatatgc

SEQ ID NO: 2159 - DNA, 499 bp, Nicotiana tabacum
ggagaaataggaggggggaaattattagaaggagaagaagaagcacttttcataaaaggttcaagtgcttccattagttcaccaccagaagtaataggttctgatgttgagtgaacatctacaggtgtactattccaaaaatccattgctgctgccattacctaaaatacctgttcacaaaaaaagttaaaaaaagtaacctgtttcttgtcaaataaaagaaaacaggtgagtgattttgattacaaatatataaacagaaaaatggatatcaaagaggtcttcaaataacaacctcttttttctcctgtgattaaaaggaaaaaaaattcaacctttgagggacaactaataagccctctaagctgattttgaaagaaagaaaaaaaggtctgaaactatactgagttaattattactagatctcgattctgaaaacacctggcttataagaaaatatttcgtctaattaaaagcttgcattttctccatttctttg

SEQ ID NO: 2160 - DNA, 231 bp, Nicotiana tabacum
gtgtgagttattcttctttgtctttgccttgtaaacgtaggccattcgcttcccgaggtaccagtccacctcttccttagtgttcactccctcaatctgaatcagtgaagtacttggatactggttcgatttcgaccttttgtatccaagaacagttcccctgacgtatagcctgacacgttctccttggcgtcccttcaccattttcgaatcaaggggattggagctgcg

SEQ ID NO: 2161 - DNA, 508 bp, Nicotiana tabacum
acgagatatgacagctggcatcagactgcgggaaatactggcccccatgccgatattaatctgccctgccagttgcccttgtcgttggcgaatatcctcttgggctgcgcgcagctcttcaagaattagactggcgtgctgataaaaactttcaccggcatcagttaacgtcacgcctttactacggcgaaaaaagagttgcgccgctaacccttcttctagctcctgaatagatttactcagtgccggttgcgacatattcaacattcggctcgctccgcgaatgctgccctgacgagccacttcaacaaaagcccgaatttgatgaatctttacctgaaaagccatgacgccaccgataaccgttatttatcagaccaaagaaactggcatctactttaatgcagatgattgtgtcagggtaatttatgaacggttaaaactgtgaaaaatcagttagtgataagtaaaaactatcgctacgtgaaccgggtcacactttttactg

SEQ ID NO: 2162 - DNA, 521 bp, Nicotiana tabacum
gagaactacgacgaacgaggcatcgtatggcctgacgctatcgcgccgttccaggtggcgattctgccgatgaacatgcacaaatccttccgcgtacaagagcttgctgagaaactgtacagcgaactgcgtgcacaaggtatcgaagtgctgctggatgaccgcaaagagcgtccgggcgtgatgtttgctgatatggaactgatcggtattccgcacactattgtgctgggcgaccgtaacctcgacaacgacgatatcgaatataaatatcgtcgcaacggcgagaaacagttaattaagactggtgacatcgtcgaatatctggtgaaacagattaaaggctgatgccagaaagggtcctgaatttcagggccctttttttacatggattgtataaaatggataaaccaaaggcgtactgccgcctgtttctccccagctttcttttactttcggcttgtaccgttgatatcagccagccagacccatcagccacagcagtagatgccgaggcaaaa

SEQ ID NO: 2163 - DNA, 415 bp, Nicotiana tabacum
ctcctaagcttttcaagagttccaacttccctgtgctggatgtagctgctacttttgaagctccaaatacatgttttgcaacctgaattacaagggatccaacaccaccagcacctcccaaaacaagtatggatttgccagcagagaatccagctttctcaagaccttcataagcagtttcaattgctagaggaagactagcagcctctgcaaaactcagattcttgggtttcaaagcaactagtctctcttctacagcagtggactctgccaacgacccgaactgaatcgaattcccgcggccgccatggcggccgggagcatgcgacgtcgggcccaattcgccctatagtgagtcgtattacaattcactggccgtcgttttacaacgtcgtgactgggaaaaccctggcgt

SEQ ID NO: 2164 - DNA, 536 bp, Nicotiana tabacum
ttttccggtagctctgccagtttcaagataagagaaagcttccacaaccttatcaaatgggaatggtccttttgaatcaataactggtttcaccttcccattttctaagtatgggttcagtttcttcaacatctctccatttgatgtcactacaaatctaaaacctggtgctgttactgcccctgttagcactaccacacttccaccttctttcactgccttcaccgccttttcgccctgaccaactgtatcataaacgacatcaaacttctcaggaagatgttcaaaattctccttggtgtaatcaatagctaaatcaactcctaagcttttcaagagttccaacttccctgtgctggatgtagctgctacttttgaagctccaaatacatgttttgcaacctgaattacaagggatccaacaccaccagcacctcccaaaacaagtatggatttgccagcagagaatccagctttctcaagaccttcataagcagtttcaattgctagaggaagactagcagcctctgcaaaac

SEQ ID NO: 2165 - DNA, 178 bp, Nicotiana tabacum
tgtgagtgtgtgaagtgcaaagccgccgcgttcgagaactgggtgtccggcatttggttgaatggctggccagatagtgtaaggacagttgttaactagggttagaattaaaccagagtaagtggcttgagagagagcacaaagggttaaaaagagagagagtgaaagtaaagttttt

SEQ ID NO: 2166 - DNA, 480 bp, Nicotiana tabacum
agcatacggttttcccatactttaacctgcaccgattcgctaacctacgccatgagcatacttgacaagctttgggacgacaccgtcgccggtccccgtcccgatagtggccttggcaaactccgaaaatcttccacctttaacttgggctcaagttccggcaaggaaacagaaggaagtcaagaggtggctagggtgacaaaacgtataatgatagtaaagcctccaggatatgtgagtaaagactctcctccagtttcgcctgccagtgccggttccactcctccggtatctccctttgctggtgcgggaggaaaggaggcatttcgattccgcaggcgatcagggtcatttgcatacgagaatgctagtgggattggacccagaagccctcctcctccttacgacctgtgagttatgaatcgaggctcaacatgcatgtttcagctgcttgactctatatatgttacgtgtccgact

SEQ ID NO: 2167 - DNA, 287 bp, Nicotiana tabacum
agtggaaatgctaacaggtctacgggcactagacacaaaccgtccaagccaccagcataatctggttgaatggattaagccacatttatctgatagaaggaagttgaaggacaagatggattcacggctggaagggaaatatccatccagagctgcagtacaaatagcacaactggcactgtcatgtcttggacctgaacctaaaaccagaccatcaatgaaagaagtagtggagaaactggaacagattgaagctgtcaatgaaagacccaaggagcctagagtaa

SEQ ID NO: 2168 - DNA, 375 bp, Nicotiana tabacum
ctctggcaaaggaaagaatcttactgaccactttttcgtgtttgaacttggtaagttggagagaatatcttgtttaaatttgaatatactatcttctaatatgttaattataattatttgtatattaggttcaacatgtggtgcaccccatgaacgacatgatccacaggcattggctatcccaaacaaagattcgtcttaactaaatcttataccaacgcccactactaatctcttctcaacagtaatggtatagttgttttaactaatataaacaggttatagatcaacaagaataggtttggacattaaacaactgcccagtagtgcaagtattttaaaaacggtaccaaactgcaaatattatggtgcaaa

SEQ ID NO: 2169 - DNA, 410 bp, Nicotiana tabacum
ctgttcaaatcacagtaacagcatcttgtgctgccataataattactctagtggtgtgtatatggagagtgctgaattgggaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtat

SEQ ID NO: 2170 - DNA, 469 bp, Nicotiana tabacum
gaaatcttttggaaattcattcaatacaatacgagtaatgtaatcattattattacagattattattcttctcaagtattccaatcacattttgattattgaaaatcatagatctaaaatcttgacttgacttgacttgacacagtctaatatagaaatgcaactttgcaggacaatccaattccaaacgttgatcaagtaacctgatctaggccttgacgtcttgaacaattgttgtaattgcaaatcctgtttggttagcacgatggacagtccctgctagtttattgtctgaaacattcagtagctgcaaatttccccagtagatgagcttcaagactgagattggaattttccctgataatttattaccgttcaatctcatccatcgcaaagatattaaattgccaagagatgatgggatagggccactcagcttgttattgtctaatcccaaactcactagcct

SEQ ID NO: 2171 - DNA, 371 bp, Nicotiana tabacum
tatctggaagaagagggcgcgaacaagagcagcaatacagaaactttcgtggcgatccgcgtcgacattgataactggcgctgggccggtgtgccattctacctgcgtactggtaaacgtctgccgaccaaatgttctgaagtcgtggtctatttcaaaacacctgaactgaatctgtttaaagaatcgtggcaggatctgccgcagaataaactgactatccgtctgcaacctgatgaaggcgtggatatccaggtactgaataaagttcctggccttgaccacaaacataacctgcaaatcaccaagctggatctgagctattcagaaacctttaatcagacgcatctggcggatgcctatgaacgttt

SEQ ID NO: 2172 - DNA, 230 bp, Nicotiana tabacum
gctgcttgctgcactctctctctcttggaaaatttgcaacaaagaaaaatgacgacggtggtccctacttcagaggaagatcccgtgctctccgtcgtccggtttacggcggagatgtcatggtctgacgccggcgccgatattgcagagcctcaagttaatagattgtgtgtcgaggcccaggaatgcattattgaaggaaggtggttggatttggcttcgttgatgct

SEQ ID NO: 2173 - DNA, 279 bp, Nicotiana tabacum
  modified_base (201)..(201): a, c, g or t
attttttctcttttcacaaatgccctcatttcttcttgtctctacactttctcttattcctaataatatctcactcttctcatgcccaaaactctcaacaagactattctcggatgcccataacacagctcgtgcagatgtaggcagtggaaccattaacttgggacaacggggtagcagcctatgcacaaaattatgttnctcaattggctgcagactgcaacctcttacattctcatggccaatacggcgaaaacctaactcagggaagtggcgatt

SEQ ID NO: 2174 - DNA, 610 bp, Nicotiana tabacum
  modified_base (518)..(518): a, c, g or t
cggcggcgacatcggtatccttatggagtacatgaacgtcggcacactagaaagtcttttaaaatcacaagcaactttctccgaacttagcttagcaaaaatcgctaagcaagtacttagcggactcgactacttacacaatcacaaaatcattcacagagatttaaaaccttcgaaccttctagtaaatcgcgagatggaagtaaaaatcgccgatttcggagtgagtaaaatcatgtgcaggactttagatccttgcaattcatacgttggaacttgtgcttatatgagcccagaaaggtttgatccagacacttatggagttaactacaacggttacgcagctgatatttggagtttgggcctgactttaatggaactatatatgggccactttccgttcttgccacctggacagagaccggactgggctacgctaatgtgcgccatatgcttcggtgagccgcccagtttgcctgaagggacgtcgggaaatttcagagattttatcgagtgtngtttacagaaagagtccagtaaaaggtggagcgctcagcaacttttgcaacatccgtttatactgagcatcgatttgaagtccacgtaaaaa

SEQ ID NO: 2175 - DNA, 430 bp, Nicotiana tabacum
cggcggcgacatcggtatccttatggagtacatgaacgtcggcacactagaaagtcttttaaaatcacaagcaactttctccgaacttagcttagcaaaaatcgctaagcaagtacttagcggactcgactacttacacaatcacaaaatcattcacagagatttaaaaccttcgaaccttctagtaaatcgcgagatggaagtaaaaatcgccgatttcggagtgagtaaaatcatgtgcaggactttagatccttgcaattcatacgttggaacttgtgcttatatgagcccagaaaggtttgatccagacacttatggagttaactacaacggttacgcagctgatatttggagtttgggcttgactttaatggaactatatatgggccactttccgttcttgccacccggacagatcctccgccca

SEQ ID NO: 2176 - DNA, 277 bp, Nicotiana tabacum
gtgctgcagttgctgttgctgctcccgctggtggtggtgctggtgctgcagcagctgcccctgctgcagaggaaaagaaggaagagcccaaggaagaaagtgatgacgacatggggttcagtctgtttgactaggagctcctttcagtatgatatttggttcctttttagagaattgatgaaacttggtaatagcaccctttataaggagatttttgatctgtttgtcacaattaaatgtaatcttgaggttatgatttatgaacatctgtcatgta

SEQ ID NO: 2177 - DNA, 475 bp, Nicotiana tabacum
ggggcgggggtgctgcgcaaaacgttagggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgagactcttgtggcaaatgcttaagggtgacaaatacaggcacaggagctcagaccacagtgagaatcgtggatcaatgcagcaatggcggactagacttggacgttatttcgttttccggcagctcgacacagacggaagagggaatcaacgtggccaccttattgtgaactacgagtttgttaattgtggtgacaatatgaatgttctggtatccccagttgacaaggaataaggagctatatatggccatgtttagtctttgacggcccaaataaaagtaaaaagaacgata

SEQ ID NO: 2178 - DNA, 458 bp, Nicotiana tabacum
ggggttgcgctaaacaggttaggcaacatatcatatatataacccgcagaatgttgggtgggatttgtatgcagttagtgcgtactgctcaacttgggatggtaacaagcctttggcatggaggaggaagtatggttggactgcattttgtggccctgttggacctcgtggccgagactcttgtggcaaatgcttaagggtgacaaatacaggcacaggagctcagaccacagtgagaatcgtggatcaatgcagcaatggcggactagacttggactgttaacgttttccggcagctcgacacagacggaagagggaatcaacgtggccaccttattgtgaactacgagtttgttaattgtggtgacaatatgaatgttctggtatccccagttgacaaggaataagaagctatatatggccatgtttagtctttgacggcccaaataaaagtaaaa

SEQ ID NO: 2179 - DNA, 444 bp, Nicotiana tabacum
attcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaact

SEQ ID NO: 2180 - DNA, 350 bp, Nicotiana tabacum
agtaggttccacgaaaagtccattgatgttaaaggacatgattttgagctttctgccatttggatgctgggagaagtgatgtgcccgggttataacttggggcttaatggtgattcaagctagcttagctaatcttatacatggatttaactggtcattgcctgataatatgactcctgaggacctcgacatggatgagatttttgggctctccacacctaaaaagtttccacttgctactgtgattgagccaagactttcacctaaactttactctgttctcgattcagcacttctgtggttccatcaacgatagactcattgtgttatgtcttgaactcgttgccttt

SEQ ID NO: 2181 - DNA, 351 bp, Nicotiana tabacum
gaaaaacaaaagcgatcggtatcttcctaaagttggggatagcttgccggactcagttgattggagagagaaaggtgttcttgttggagttaaggatcaaggaagctgtgggagctgttgggcattctctgcaattgcttccgttgaagcagtgaactcgatagtcaccggagatgtgatttcactatcggagcaagaactggtggattgtgatacttcctacaatgacggctgcaatggcggtcttatggactatgcctttgatttcatcatcaaaaatggaggaattgacactgaggaagactacccttacacaggccgtgatggcagatgtgaccagtcaaggaaaaa

SEQ ID NO: 2182 - DNA, 469 bp, Nicotiana tabacum
ctgataaacatcttcgatttgatccttaaaaaatttgcagcttcaaagatggaaaatggccaagaaaatcatgaaaacattcaaactgaagaaatcccagatgaatttcaatgctgtgtttgcctggaacttttgtataaaccagttgtgctagggtgtggccacattgcttgtttctggtgtatatttaagtccatgaatactttgatggagtcaaactgtcccatttgtcgtcacccttatcatcatttccctagtgtgtgtagattgatgcactttttgcttgtaaagttgtaccctttagacagtgcaagaagggaaaaacaagtggcagaggaggagaaggaagtaggatatttttcacctcagtttgatgattatttatcagaatcctgtggcaagaccgatcttgttctagacacggcttcacttcattccatcccttcacagaaatgtggatcagcagggg

SEQ ID NO: 2183 - DNA, 546 bp, Nicotiana tabacum
cagcacgatagaatgaccaagacgtcaattctcctgcctcaaacagtggcgctggtggtggctccttataatccttgtcactctgcgctgccgtcccaattgcctgcctctctgaatatttgtttgctcctaatcttacatcttcttctttgttctccattctttcctcgtgccgaattcctgcagcccgggggatccactagttctagagcggccgccaccgcggtggagctccagcttttgttccctttagtgagggttaattaagggcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggc

SEQ ID NO: 2184 - DNA, 375 bp, Nicotiana tabacum
ctcagctacgctgcttgctgcactctgtctctctctctctccctctctcttggaaaatttgcaacaaagaaaaatgacgacggtggtccctacttcagaggaagatcccgtgctctccgtcgtccggtttacggcggagatgtcatggtctgacgccggcgccgatattgcagagcctcaagttaatagattgtgtgtcgaggcccaggaatgcattattgaaggaaggtggttggatttggcttcgttgatgctcacttccgcagatttaatattttctaaagcttctgaaaaagatcttgagtgcattttcactatcatttgcaaccttgtcaagaagcctgagagcttggaccaagtacatgagatggcaga

SEQ ID NO: 2185 - DNA, 228 bp, Nicotiana tabacum; identical to SEQ ID NO: 1383

SEQ ID NO: 2186 - DNA, 484 bp, Nicotiana tabacum
aaccaaccttccttttcttacttagtaaaatggatattcagtcttctcctttcaacttaattgctttgctactcttcatttcatttctttttatcctattgaaaaagtggaataccaaaatcccaaagttacctccaggtccatggagacttccccttattggcagcctccatcacttgaaaggtaaactcccacaccatcatcttagagatttagcccgaaaatatggacctctcatgtatttacaacttggagaagttcctgtagttgtaatatcttcgccacgtatagcaaaagctgtactaaaaactcatgatcttgcttttgcaacgaggcctcggttcatgtcctcggacattgtgttttacaaaagcagggacatatcattcgccccatatggcgattactggagacaaatgcgtaaaatattaacacaagaactcttgagtaacaagatgctcaagtcatttagcacaatccgaaa

SEQ ID NO: 2187 - DNA, 373 bp, Nicotiana tabacum
gagagagagagagagaggggataattgaaagtttaaaagtagtccaaaaatggaaggtgaaaaggaaaggattaaaatggcaagtgataagtacaggaaattcctgcatgaagaacaagctgcttactgcaggaagcatccattggagacatggtggccctcccatttatgacgctgttaatcatctctttgaacaaggaagaaccaaggtatgggcagaagggtctctggaagaaacagttcaaaatgctataaaatcatgggaaatggggctttctcacaagactcgcgttaaggactttaggaccattaaccctgaaaaattcaaactctttgttaatggaagagagggactatcagcagaagagacact

SEQ ID NO: 2188 - DNA, 496 bp, Nicotiana tabacum; identical to SEQ ID NO: 1702

SEQ ID NO: 2189 - DNA, 491 bp, Nicotiana tabacum
caagtcttcccatcatgtctacctcacataaacataatactcctcaaatggctgctatcacactcctaggattactacttgttgccagcagcattgacatagcaggggctcaatcgataggtgtttgctatggaatgttaggcaacaacttgccaaatcattgggaagttatacagctctacaagtcaagaaacataggaagactgaggctttatgatccaaatcatggagctttacaagcattaaaaggctcaaatattgaagttatgttaggacttcccaattcagatgtgaagcacattgcttccggaatggaacatgcaagatggtgggtacagaaaaatgttaaagatttctggccagatgttaagattaagtatattgctgttgggaatgaaatcagccctgtcactggcacatcttacctaacctcatttcttactcctgctatggtaaatatttacaaagcaattggtgaagctggtttggga

SEQ ID NO: 2190 - DNA, 371 bp, Nicotiana tabacum
aattgctggaagctagccatggggagaagacctgcaaggtgttaccgccagattaagaacaagccttacccaaaatcacggttttgccgtggtgtccctgatccaaagatcaggatctatgatgttggcatgaagaaaaagggagttgatgagtttcctttctgtgtacacttggtcagttgggagaaggagaatgtctcaagtgaggcacttgaagctgcccgtattgcttgcaacaagtacatgaccaagtctgctgggaaggatgcctttcaccttagggtcagggtccatcctttccatgttttgcgtattaataagatgttgtcatgtgctggagcggataggctccaaactggcatgaggggagc

SEQ ID NO: 2191 - DNA, 428 bp, Nicotiana tabacum; identical to SEQ ID NO: 1883

SEQ ID NO: 2192 - DNA, 485 bp, Nicotiana tabacum
ttttgtaacaaacatattagataatggcttttattcatacttaatacagcaagctctgaagtatgaaagagcattactattacagctttgccattacaaaggttttatatattacacgatgatcagtgttgaggcttcccttcagtcactttatccatggcctcacctttgtagtagcaacacctgctgcagccgtagtaattgcggcggccgcaacaaccatagcggcagtatcctccacgtccaccaccgcggccgccacctgggtatccaccacggccgccaccagggtatccaccgccaccacggccgccaccagggtatccgccgccagggtatccaccgccagggtagccaccaccggggtatccgccaccatattgagcttcatgcacttcattcttgttatcggatttctttgagtcctcttctgaagtggtggaagtctcagacaactccctagctaaaacctcagagcttatcat

SEQ ID NO: 2193 - DNA, 263 bp, Nicotiana tabacum
cggcggtggtggtggtatttttggtgcacttggaagtgtaagagacgcaattaaagacacattagcaccatctagtatgcgtgacactaccactacagatgagacgcgtaccggcggatcgaagatagtggtggatgtcgaggatactccggcggggagaaccgccgcgacgctgaaagtggccgatcagttgaccggccagacgtttaacgacgtcgagagaatggatgtggagggcattgccgaggttgaggccaaggata

SEQ ID NO: 2194 - DNA, 36 bp, Artificial Sequence
  Description of Artificial Sequence: Synthetic primer
tagctacgcggatccatgctttctcccatagaagcc

SEQ ID NO: 2195 - DNA, 35 bp, Artificial Sequence
  Description of Artificial Sequence: Synthetic primer
agtcaattatcttctacaaacctttatatattagc

SEQ ID NO: 2196 - protein, 83 aa, Nicotiana tabacum
EVLRLYPPGPLLVPHENVEDCVVSGYHIPKGTRLFANVMKLQRDPKLWSDPDTFDPERFIATDIDFRGQYYKYIPFGPGRRSC

SEQ ID NO: 2197 - protein, 83 aa, Nicotiana tabacum
EVLRLYPPGPLLVPHENVEDCVVSGYHIPKGTRLFANVMKLLRDPKLWPDPDTFDPERFIATDIDFRGQYYKYIPFGSGRRSC

SEQ ID NO: 2198 - protein, 83 aa, Nicotiana tabacum
EVLRLYPPGPLLVPHENVEDCVVSGYHIPKGTRLFANVMKLQRDPKLWSDPDTFDPERFIATDIDFRGQYYKYIPFGSGRRSC

SEQ ID NO: 2199 - protein, 83 aa, Nicotiana tabacum
EVLRLYPPGPLLVPHENVEDCVVSGYHIPKGTRLFANVMKLQRDPKLWSNPDKFDPERFFADDIDYRGQHYEFIPFGSGRRSC

SEQ ID NO: 2200 - protein, 83 aa, Nicotiana tabacum
KVLRLYPPGPLLVPHENVKDCVVSGYHIPKGTRLFANVMKLQRDPKLLSNPDKFDPERFIAGDIDFRGHHYEFIPSGSGRRSC

SEQ ID NO: 2201 - protein, 83 aa, Nicotiana tabacum
KVLRLYPPGPLLVPHENVKDCVVSGYHIPKGTRLFANVMKLQRDPKLLSNPDKFDPERFIAGDIDFRGHHYEFIPFGSGRRSC

SEQ ID NO: 2202 - protein, 83 aa, Nicotiana tabacum
KVLRLYPPGPLLVPHEYVKDCVVSGYHIPKGTRLFANVMKLQRDPKLLSNPDKFDPERFIAGDIDFRGHHYEFIPFGSGRRSC

SEQ ID NO: 2203 - protein, 85 aa, Nicotiana tabacum
ETLRLYPPVPFLLPHEAVQDCKVTGYHIPKGTRLYINAWKVHRDPEIWSEPEKFMPNRFLTSKANIDARGQNFEFIPFGSGRRSC

SEQ ID NO: 2204 - protein, 85 aa, Nicotiana tabacum; identical to SEQ ID NO: 2203

SEQ ID NO: 2205 - protein, 85 aa, Nicotiana tabacum
ETLRLFPPVPFLLPHEAVQDCKVTGYHIPKGTRLYINAWKVHRDPEIWSEPEKFMPNRFLTSKANIDARGQNFEFIPFGSGRRSC

SEQ ID NO: 2206 - protein, 85 aa, Nicotiana tabacum; identical to SEQ ID NO: 2205

SEQ ID NO: 2207 - protein, 85 aa, Nicotiana tabacum
ETLRLYPPVPFLLPHEAVQDCKVTGYHIPKGTRLYINAWKVHRDSEIWSEPEKFMPNRFLTSKANIDARGQNFEFIPFGSGRRSC

SEQ ID NO: 2208 - protein, 81 aa, Nicotiana tabacum
ETFRMYPAGPLLVPHESSEETTVGGYRVPGGTMLLVNLWAIHNDPKLWDEPRKFKPERFEGLEGVRDGYKMMPFGSGRRSC

SEQ ID NO: 2209 - protein, 81 aa, Nicotiana tabacum
ETFRMYPAGPLLVPHESSEETTVGGYRVPGGTMLLVNLWAIHNDPKLWDEPRKFKPERFQGLDGVRDGYKMMPFGSGRRSC

SEQ ID NO: 2210 - protein, 83 aa, Nicotiana tabacum
ETMRLYTPIPLLLPHYSTKDCIVEGYDVPKHTMLFVNAWAIHRDPKVWEEPDKFKPERFEATEGETERFNYKLVPFGMGRRAC

SEQ ID NO: 2211 - protein, 83 aa, Nicotiana tabacum; identical to SEQ ID NO: 2210

SEQ ID NO: 2212 - protein, 83 aa, Nicotiana tabacum; identical to SEQ ID NO: 2210

SEQ ID NO: 2213 - protein, 83 aa, Nicotiana tabacum
ETMRLHPVAPMLVPRECREDIKVAGYDVQKGTRVLVSVWTIGRDPTLWDEPEVFKPERFHEKSIDVKGHDYELLPFGAGRRMC

SEQ ID NO: 2214 - protein, 83 aa, Nicotiana tabacum; identical to SEQ ID NO: 2213

SEQ ID NO: 2215 - protein, 83 aa, Nicotiana tabacum
ETMRLHPVAPMLVPRECREDIKVAGYDVQKGTRVLVSVWTIGRDPTLWDEPEVFKPERFHERSIDVKGHDYELLPFGAGRRMC

SEQ ID NO: 2216 - protein, 83 aa, Nicotiana tabacum
EALRLHPPTPLMLPHRASASVKIGGYDIPKGSIVHVNVWAVARDPAVWKNPLEFRPERFLEEDVDMKGHDYRLLPFGAGRRVC

SEQ ID NO: 2217 - protein, 83 aa, Nicotiana tabacum
EALRLHPPTPLMLPHKASASVKIGGYDIPKGSIVHVNVWAVARDPAVWKNPLEFRPERFLEEDVDMKGHDYRLLPFGAGRRVC

SEQ ID NO: 2218 - protein, 83 aa, Nicotiana tabacum
ETLRLHPLGTMLAPHCAIEDCNVAGYDIQKGTTFLVNVWTIGRDPKYWDRAQEFLPERFLENDIDMDGHNFAFLPFGSGRRRC

SEQ ID NO: 2219 - protein, 83 aa, Nicotiana tabacum
ETLRLHPLGTMLAPHCAIEDCNVAGYDIQKGTTVLVNVWTIGRDPKYWDRAQEFLPERFLENDIDMDGHNFAFLPFGSGRRRC

SEQ ID NO: 2220 - protein, 83 aa, Nicotiana tabacum; identical to SEQ ID NO: 2219

SEQ ID NO: 2221 - protein, 83 aa, Nicotiana tabacum
EVLRLYPAGYVINRMVNKETKLGNLCLPAGVQLVLPTMLLQHDTEIWGDDAMEFNPERFSDGISKATKGKLVFFPFSWGPRIC

SEQ ID NO: 2222 - protein, 83 aa, Nicotiana tabacum; identical to SEQ ID NO: 2221

SEQ ID NO: 2223 - protein, 83 aa, Nicotiana tabacum
EVLRLYPAGYAINRMVTKETKLGNLCLPAGVQLLLPTILLQHDTEIWGDDAMEFNPERFSDGISKATKGKLVFFPFSWGPRIC

SEQ ID NO: 2224 - protein, 83 aa, Nicotiana tabacum
ESLRLYPPIATRTRRTNEETKLGELDLPKGALLFIPTILLHLDKEIWGEDADEFNPERFSEGVAKATKGKMTYFPFGAGPRKC

SEQ ID NO: 2225 - protein, 83 aa, Nicotiana tabacum
ESLRLYPPIATRTRRTNEETKLGELDLPKGALLFIPTILLHLDREIWGEDADEFNPERFSEGVAKATKGKMTYFPFGAGPRKC

SEQ ID NO: 2226 - protein, 83 aa, Nicotiana tabacum
ETLRMHPPIPLLVPRECMEDTKIDGYNIPFKTRVIVNAWAIGRDPESWDDPESFMPERFENSSIDFLGNHHQFIPFGAGRRIC

SEQ ID NO: 2227 - protein, 83 aa, Nicotiana tabacum; identical to SEQ ID NO: 2226

SEQ ID NO: 2228 - protein, 83 aa, Nicotiana tabacum; identical to SEQ ID NO: 2226

SEQ ID NO: 2229 - protein, 83 aa, Nicotiana tabacum
ETLRMHPPIPLLVPRECMEDTKIDGYNIPFKTRVIVNAWAIGRDPQSWDDPESFTPERFENNSIDFLGNHHQFIPFGAGRRIC

SEQ ID NO: 2230 - protein, 83 aa, Nicotiana tabacum; identical to SEQ ID NO: 2229

SEQ ID NO: 2231 - protein, 83 aa, Nicotiana tabacum
ETLRMHPPVPLLGPRECRDQTEIDGYTVPIKARVMVNAWAIGRDPESWEDPESFKPERFENTSVDLTGNHYQFIPFGSGRRMC

SEQ ID NO: 2232 - protein, 83 aa, Nicotiana tabacum; identical to SEQ ID NO: 2231

SEQ ID NO: 2233 - protein, 83 aa, Nicotiana tabacum; identical to SEQ ID NO: 2231

SEQ ID NO: 2234 - protein, 83 aa, Nicotiana tabacum
ETLRMHPPVPLLGPRECREQTEIDGYTVPLKARVMVNAWAIGRDPESWEDPESFKPERFENISVDLTGNHYQFIPFGSGRRMC

SEQ ID NO: 2235 - protein, 83 aa, Nicotiana tabacum; identical to SEQ ID NO: 2234

SEQ ID NO: 2236 - protein, 83 aa, Nicotiana tabacum; identical to SEQ ID NO: 2234

SEQ ID NO: 2237 - protein, 83 aa, Nicotiana tabacum
ETLRLHPPTPLLVPRECREETEIEGFTIPLKSKVLVNVWAIGRDPENWKNPECFIPERFENSSIEFTGNHFQLLPFGAGRRIC

SEQ ID NO: 2238 - protein, 83 aa, Nicotiana tabacum; identical to SEQ ID NO: 2237

SEQ ID NO: 2239 - protein, 83 aa, Nicotiana tabacum
ETLRLHPPVPLLLPRECREETNINGYTIPVKTKVMVNVWALGRDPKYWNDAETFMPERFEQCSKDFVGNNFEYLPFGGGRRIC

SEQ ID NO: 2240 - protein, 83 aa, Nicotiana tabacum; identical to SEQ ID NO: 2239

SEQ ID NO: 2241 - protein, 83 aa, Nicotiana tabacum; identical to SEQ ID NO: 2239

SEQ ID NO: 2242 - protein, 83 aa, Nicotiana tabacum; identical to SEQ ID NO: 2239

SEQ ID NO: 2243 - protein, 83 aa, Nicotiana tabacum
ETLRLHPPVPLLLPRECREETNINGYTIPVKTKVMVNVWALGRDPKYWDDAETFKPERFEQCSKDFVGNNFEYLPFGGGRRIC

SEQ ID NO: 2244 - protein, 83 aa, Nicotiana tabacum
ETLRLHPPIPLLLHETAEESTVSGYHIPAKSHVIINSFAIGRDKNSWEDPETYKPSRFLKEGVPDFKGGNFEFIPFGSGRRSC

SEQ ID NO: 2245 - protein, 83 aa, Nicotiana tabacum; identical to SEQ ID NO: 2244

SEQ ID NO: 2246 - protein, 83 aa, Nicotiana tabacum
EIFRLYPPAPLLVPRESMEKTILEGYEIRPRTIVHVNAWAIARDPEIWENPDEFIPERFLNSSIDYKGQDFELLPFGAGRRGC

SEQ ID NO: 2247 - protein, 83 aa, Nicotiana tabacum; identical to SEQ ID NO: 2246

SEQ ID NO: 2248 - protein, 83 aa, Nicotiana tabacum; identical to SEQ ID NO: 2246

SEQ ID NO: 2249 - protein, 83 aa, Nicotiana tabacum
EIFRLYPPAPLLVPRESMEKTILEGYEIRPRTIVHVNAWAIARDPEIWENPDEFIPERFLNSSTDYKGQDFELLPFGAGRRGC

SEQ ID NO: 2250 - protein, 85 aa, Nicotiana tabacum
EALRLRMAIPLLVPHMNLHDAKLGGFDIPAESKILVNAWWLANNPAHWKKPEEFRPERFFEEEKHVEANGNDFRYLPFGVGRRSC

SEQ ID NO: 2251 - protein, 85 aa, Nicotiana tabacum
EALRLRMAIPLLVPHMNLHDAKLGGLDIPAESKILVNAWWLANNPAHWKKPEEFRPERFFEEEKHVEANGNDFRYLPFGVGRRSC

SEQ ID NO: 2252 - protein, 85 aa, Nicotiana tabacum
ETLRLRMAIPLLVPHMNLHDAKLGGFDIPAESKILVNAWWLANNPAHWKKPEEFRPERFFEEEKHVEANGNDFRYLPFGVGRRSC

SEQ ID NO: 2253 - protein, 82 aa, Nicotiana tabacum
ESLRLYSPVVSLIRRPNEDAILGNVSLPEGVLLSLPVILLHHDEEIWGKDKKFNPERFRDGVSSATKGQVTFFPFTWGPRIC

SEQ ID NO: 2254 - protein, 83 aa, Nicotiana tabacum
ESLRLYPPVVTLTRRPKEDTVLGDVSLPAGVLISLPVILLHHDEEIWGKDAKKFKPERFRDGVSSATKGQVTFFPFTWGPRIC

SEQ ID NO: 2255 - DNA, 18 bp, Nicotiana tabacum
  modified_base (4)..(6): deoxyinosine
  modified_base (9)..(9): deoxyinosine
  modified_base (15)..(15): deoxyinosine
ttynnnccngarmgntty

SEQ ID NO: 2256 - DNA, 20 bp, Nicotiana tabacum
  modified_base (3)..(3): deoxyinosine
  modified_base (6)..(6): deoxyinosine
  modified_base (9)..(12): deoxyinosine
  modified_base (18)..(18): deoxyinosine
ggnmgnmgnnnntgyccngs

SEQ ID NO: 2257 - DNA, 17 bp, Nicotiana tabacum
ttyaarcctgagagatt

SEQ ID NO: 2258 - DNA, 15 bp, Nicotiana tabacum
ccagaragattcttg

SEQ ID NO: 2259 - DNA, 17 bp, Nicotiana tabacum
ggrmgrmgratgtgycc

SEQ ID NO: 2260 - DNA, 19 bp, Nicotiana tabacum
  modified_base (19)..(19): a, c, g or t
ttttttttttttttttttn

SEQ ID NO: 2261 - DNA, 20 bp, Nicotiana tabacum
attatgctgagtgatatccc

SEQ ID NO: 2262 - DNA, 18 bp, Nicotiana tabacum
atttaggtgacactatag

SEQ ID NO: 2263 - DNA, 452 bp, Nicotiana tabacum
cggcctcgagtctagtgtttcaaagatgaagcttacttcccagtgaatcttttggccttcttcaccatagcatctctggtcactacagctgtttgtaaaatgttgagtgcctaagatcgaattttataaccaaccctgagccatgaaaggagtcatttgttcgtggaagctagcttcaagtgattcaatgtatagctaatccttcaacaagacatttgtggtaccaaacatgtatatttatgctgtcccatagaagagagtacaaaagaagcaagcttgcaaattaaataggtttagggccctttatctcctccgctttcacccttttggggatggaggttgaggttgttgtacagtgaacaatgaactgaaaatattgcagatactgttgattaaacaatctgagatgacagcacatttcttttctatattttgcttcttcgactgcaaaa

SEQ ID NO: 2264 - DNA, 405 bp, Nicotiana tabacum
gtaagatgtccaagtcattgggaaatgttattgatcctcttgaagttattaatggaattgaacttgctggacttcataagagattaaaggagggtaacctggacgccaaagaatttgagagggcaaaagagggacaggcaaaggactttcctagtggtattcctgaatgtggtgcagatgctcttcgatttgccctagtctcatacactgcccagtccgataagatcaatctggatattcaaagagtggttgggtatcgtcaatggtgtaacaaactgtggaatgccattaggtttgccatgagtaaactgggtgaagattacacccctccaacaaagatagttcctcgtgaaatgccttttagctgccaatggatactctcagcacttaacaaggccattgcga

SEQ ID NO: 2265 - protein, 7 aa, Artificial Sequence
  Description of Artificial Sequence: Synthetic conserved p450 motif peptide
  MOD_RES (2)..(2): Any amino acid
  MOD_RES (4)..(4): Any amino acid
  MOD_RES (6)..(6): Any amino acid
  MOD_RES (7)..(7): Gly or Ala
GXRXCXX

SEQ ID NO: 2266 - protein, 21 aa, Artificial Sequence
  Description of Artificial Sequence: Synthetic peptide
DIDGSKSKLVKAHRKIDEILG

SEQ ID NO: 2267 - protein, 22 aa, Artificial Sequence
  Description of Artificial Sequence: Synthetic peptide
FKNNGDEDRHFSQKLGDLADKY

SEQ ID NO: 2268 - protein, 6 aa, Artificial Sequence
  Description of Artificial Sequence: Synthetic peptide
  MOD_RES (2)..(2): Any amino acid
FXPERF

SEQ ID NO: 2269 - protein, 7 aa, Artificial Sequence
  Description of Artificial Sequence: Synthetic conserved p450 motif peptide
  MOD_RES (4)..(4): Any amino acid
  MOD_RES (7)..(7): Gly or Ala
GRRXCPX

SEQ ID NO: 2270 - protein, 509 aa, Nicotiana tabacum
MEGTNLTTYAAVFLGTLFLLFLSKLLRQRKLNLPPGPKPWPIIGNLNLIGNLPYRSIHELSLKYGPVMQLQFGSFPVVVGSSVEMAKIFLKSMDINFVGRPKTAAGKYTTYNYSDITWSPYGPYWRQARRMCLTELFSTKCLDSYEYIRAEELHSLLHNLNKISGKPIVLKDYLTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMEDVLLQLADDPKLEVKLERHGVKAFTQDMLAGGTESSAVTVEWAISELSKKPEIFKKATEELDRVIGQNRWVQEKDIPNLPYIEAIVKETMRLHPVAPMKATECRENSKVAGYDVQKGTRVLVSVWTIGRDPTLWDEPEVFKPERFHEKASIDVKGHDYELLPFGVGRRMCPGYSLGLKVIQASLANLLHGFNWSLPDNMTPEDLNMDEIFGLSTPKKFPLATVIEPRLSPKLYSV

SEQ ID NO: 2271 - protein, 509 aa, Nicotiana tabacum
MEGTNLTTYAAVFLGTLFLLLLSKFLRQRKLNLPPGPKPWPIIGNLNLIGNLPHRSIHELSLKYGPIMQLQFGTFPVVVGSSVEMAKVFLKSMDINFVGRPKTAAGKYTTYNYSDITWSPYGPYWRQARRMCLMELFSTKRLDSYEYIRAEELHSLLHNLNKISGKPIVLKDYLTTLSLNVISRMVLGKRYLDESENSIVTPEEFKKMLDELFLLNGVLNIGDSIPWIDFMDLQGYVKRMKFVSKKFDKFLEHVIDEHNVRRNGVENYIAKDMVDVLLQLADDPTLEVKLERHGVKAFTQDMLAGGTESSAVTVEWAISELLKKPEIFKKATEELDRVIGQNRWVQEKDIPNLPYIEAIVKETMRLHPVAPMLVPRECREDCKVAGYDVKKGTRVLVSVWTIGRDPTLWDEPEAFKPERFHEKSIDVKGHDFELLPFGAGRRMCPGYNLGLKVIQASLANLIHGFNWSLPDNMTPEDLDMDEIFGLSTPKKFPLATVIEPRLSPKLYSV

SEQ ID NO: 2272 - protein, 473 aa, Nicotiana tabacum
MQFFSLVSIFLFLAFLFLLRKWKNSNSQSKKLPPGPWKIPILGSMLHMIGGEPHHVLRDLAKKYGPLMHLQLGEISAVVVTSRDMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDIFAKKIREVIGLAEGFDVVDIFPTYKFLHVLSGMKRKLLNAHLKVDAIVEDVINEHKKNLAAGKSNGALEDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSVDFFGNNFEFLPFGGGRRICPGMSFGLANLYLPLAQLLYHFDWKLPTGIMPRDLDLTELSGITIARKGDLYLNATPYQPSRE

SEQ ID NO: 2273 - protein, 7 aa, Artificial Sequence
  Description of Artificial Sequence: Synthetic conserved p450 motif peptide
  MOD_RES (2)..(2): Any amino acid
  MOD_RES (4)..(4): Any amino acid
  MOD_RES (7)..(7): Gly or Ala
GXRXCPX

SEQ ID NO: 2274 - protein, 7 aa, Artificial Sequence
  Description of Artificial Sequence: Synthetic conserved p450 motif peptide
  MOD_RES (1)..(1): Glu or Lys
  MOD_RES (2)..(3): Any amino acid
  MOD_RES (5)..(6): Any amino acid
  MOD_RES (7)..(7): Pro, Thr, Ser or Met
XXXRXXX

SEQ ID NO: 2275 - protein, 6 aa, Artificial Sequence
  Description of Artificial Sequence: Synthetic conserved p450 motif peptide
  MOD_RES (2)..(2): Any amino acid
  MOD_RES (5)..(5): Any amino acid
PXRFXF

SEQ ID NO: 2276 - protein, 5 aa, Artificial Sequence
  Description of Artificial Sequence: Synthetic conserved p450 motif peptide
  MOD_RES (2)..(2): Any amino acid
  MOD_RES (4)..(4): Any amino acid
GXRXC

SEQ ID NO: 2277 - protein, 519 aa, Nicotiana tabacam
MYHLLSPIEAIVGLVTFAFLLYLLWTKKQSKILNPLPPKIPGGWPVIGHLFYFNNNGDDDRHFSQKLGDLADKYGPVFTFRLGFRRFLAVSSYEAMKECFSTNDIHFADRPALLYGEYLCYNNAMLAVAKYGPYWKKNRKLVNQELLSVSRLEKFKHVRFSIVQKNIKQLYNCDSPMVKINLSDWIDKLTFDIILKMVVGKTYNNGHGEILKAAFQKFMVQAMEIELYDVFHIPFFKWLDLTGNIKAMKQTFKDIDNIIQGWLDEHIKKRETKDVGGENEQDFIDVLLSKRSNEHLGDGYSHDTTIKATVFTLVLDATDTLALHIKWVMALMINNKNVMKKAQEEMDTIVGRDRWVEENDIKNLVYLQAIVKEVLRLHPPAPLSVQHLSVKDCVVNGYHIPKGTALLTNIMKLQRDPQIWVDPDTFDPERFLTTNAAIDYRGQHYELIPFGSGRRACPAMNYSLQVEHLSIAHLIQGFNFATTTNEPLDMKQGVGLTLPKKTDVEVLITPRLPPTLYQY

SEQ ID NO: 2278 - protein, 473 aa, Nicotiana tabacam; identical to SEQ ID NO: 2272

SEQ ID NO: 2279 - protein, 509 aa, Artificial Sequence; identical to SEQ ID NO: 2271
  Description of Artificial Sequence: Synthetic primer

SEQ ID NO: 2280 - DNA, 36 bp, Artificial Sequence
  Description of Artificial Sequence: Synthetic primer
ggctctagataaatctcttaagttactaggttctaa

SEQ ID NO: 2281 - DNA, 44 bp, Artificial Sequence
  Description of Artificial Sequence: Synthetic primer
ggctctagaagtcaattatcttctacaaacctttatatattagc

SEQ ID NO: 2282 - DNA, 27 bp, Artificial Sequence
  Description of Artificial Sequence: Synthetic primer
ctctattgatactagctggttttggac

SEQ ID NO: 2283 - DNA, 26 bp, Artificial Sequence
  Description of Artificial Sequence: Synthetic primer
ggagggagagtataacttacggattc

SEQ ID NO: 2284 - DNA, 26 bp, Artificial Sequence
  Description of Artificial Sequence: Synthetic primer
agtaaccgattgctcacgttatcctc

SEQ ID NO: 2285 - DNA, 25 bp, Artificial Sequence
  Description of Artificial Sequence: Synthetic primer
ctctattcaaccccacacgtaactg

SEQ ID NO: 2286 - DNA, 27 bp, Artificial Sequence
  Description of Artificial Sequence: Synthetic primer
ctaaactctggtctgatcctgatactt

SEQ ID NO: 2287 - DNA, 27 bp, Artificial Sequence
  Description of Artificial Sequence: Synthetic primer
ctatacgtaaggtaaatcctgtggaac

SEQ ID NO: 2288 - DNA, 18 bp, Artificial Sequence
  Description of Artificial Sequence: Synthetic primer
tctctaaagtccccttcc

SEQ ID NO: 2289 - DNA, 18 bp, Artificial Sequence
  Description of Artificial Sequence: Synthetic primer
ccagcattcctcaatttc

SEQ ID NO: 2290 - DNA, 36 bp, Artificial Sequence; identical to SEQ ID NO: 2280
  Description of Artificial Sequence: Synthetic primer

SEQ ID NO: 2291 - DNA, 44 bp, Artificial Sequence; identical to SEQ ID NO: 2281
  Description of Artificial Sequence: Synthetic primer

SEQ ID NO: 2292 - DNA, 31 bp, Artificial Sequence
  Description of Artificial Sequence: Synthetic primer
gcccatcctacagttacctataaaaaggaag

SEQ ID NO: 2293 - DNA, 27 bp, Artificial Sequence
  Description of Artificial Sequence: Synthetic primer
accaagatgaaagatcttaggttttaa

SEQ ID NO: 2294 - DNA, 16 bp, Artificial Sequence
  Description of Artificial Sequence: Synthetic primer
ctgatcgtgaagatga

SEQ ID NO: 2295 - DNA, 17 bp, Artificial Sequence
  Description of Artificial Sequence: Synthetic primer
tgctgcatccaagacca

SEQ ID NO: 2296 - DNA, 17 bp, Artificial Sequence
  Description of Artificial Sequence: Synthetic primer
gggctatatggattcgc

SEQ ID NO: 2297 - DNA, 60 bp, Artificial Sequence
  Description of Artificial Sequence: Synthetic primer
ctggatcacaattgttagtgatggtgatggtgatgcgatcctctataaagctcaggtgcc

SEQ ID NO: 2298 - protein, 281 aa, Nicotiana tabacum
IDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFELLPFGAGRRGCPGIALGVASMELALSNLLYAFDWELPYGVKKEDIDTNVRPGIAMHKKNELCLVPKKLFINYIGTWISC

SEQ ID NO: 2299 - protein, 101 aa, Nicotiana tabacum
RDPKLWPNPDNFDPERFIAADIDFRGQHYEYIPFGSGRRSCPGMTYALQAEHLTMAHLIQGFNYRTPTNEPLDMKEGAGITIRKVNPVEVLIKPRLAPELY

SEQ ID NO: 2300 - protein, 473 aa, Nicotiana tabacum
MEFFSLVSIFLFLSFLFLLRKCKNSNSQTKQLPPGPWKIPILGSMLHMLGGEPHHILRDLAKKYGPIMHLQFGEISAVVVTSREMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDVFAKKIREVIGLAEGFDVADIFPSYKFLHVLSGMKRKLLNAHLKVDAIVEDVINEHKKNLATGKTNGALGDMFAAGTETSSTTTVWAMAEMMKNPNVFNKAQAEVRETFKDKVTFDEIDAEELEYLKLVIKETLRLHPPSPLLVPRECREDTDINGYTIPAKTKVMVNVWALGRDPKYWDDAESFKPERFEQCSVDFFGNNFEFLPFGGGRRICPGMSFGLANLYLPLAQLLYHFDWKLPSGMMPGDLDLTELAGITIARKGDLYLMATPYQPSRE

SEQ ID NO: 2301 - protein, 6 aa, Nicotiana tabacum
FKPERF

SEQ ID NO: 2302 - protein, 5 aa, Nicotiana tabacum
PERFL

SEQ ID NO: 2303 - protein, 6 aa, Nicotiana tabacum
GRRMCP

What is claimed is:

1. A method for reducing the expression of nicotine demethylase in a tobacco plant, said method comprising expressing a transgene encoding a double-stranded RNA molecule that inhibits expression of said nicotine demethylase in said plant, said double-stranded RNA molecule comprising at least 25 consecutive nucleotides that have 91% or greater sequence identity to an exon of SEQ ID NO: 4, wherein expression of said nicotine demethylase is inhibited in said plant relative to a tobacco plant lacking said transgene.

2. The method of claim 1, wherein said tobacco plant is from a species selected from the group consisting of *Nicotiana tabacum, Nicotiana sylvestris, Nicotiana tomentosiformis* and *Nicotiana glauca*.

3. The method of claim 1, wherein said transgene comprises a constitutive promoter.

4. The method of claim 1, wherein said transgene comprises an inducible promoter.

5. The method of claim 1, wherein said double-stranded RNA molecule encoded by said transgene further comprises an intron.

6. The method of claim 5, wherein said intron has 91% or greater sequence identity to nucleotides 2950 to 3946 of SEQ ID NO: 4.

7. The method of claim 1, wherein said double-stranded RNA molecule comprises at least 100 nucleotides that have 91% or greater sequence identity to an exon of SEQ ID NO: 4.

8. The method of claim 7, wherein said double-stranded RNA molecule comprises at least 100 nucleotides that have 100% sequence identity to an exon of SEQ ID NO: 4.

9. The method of claim 1 wherein said double-stranded RNA molecule comprises at least 250 nucleotides that have 91% or greater sequence identity to an exon of SEQ ID NO: 4.

10. The method of claim 9 wherein said double-stranded RNA molecule comprises at least 250 nucleotides that have 100% sequence identity to an exon of SEQ ID NO: 4.

11. The method of claim 1, wherein said double-stranded RNA molecule comprises at least 500 nucleotides that have 91% or greater sequence identity to an exon of SEQ ID NO: 4.

12. The method of claim 1, wherein said tobacco plant is *Nicotiana tabacum*.

* * * * *